US012624118B2

(12) United States Patent
Granda et al.

(10) Patent No.: US 12,624,118 B2
(45) Date of Patent: *May 12, 2026

(54) TRISPECIFIC BINDING MOLECULES AGAINST BCMA AND USES THEREOF

(71) Applicant: Novartis AG, Basel (CH)

(72) Inventors: Brian Walter Granda, Salisbury, MA
(US); John Blankenship, Acton, MA
(US); Aida Abujoub, Winchester, MA
(US); Tony Fleming, Stow, MA (US);
Lu Huang, West Roxbury, MA (US);
Connie Hong, Somerville, MA (US);
Brian Holmberg, Somerville, MA
(US); Haihui Lu, Winchester, MA (US)

(73) Assignee: NOVARTIS AG, Basel (CH)

( * ) Notice: Subject to any disclaimer, the term of this
patent is extended or adjusted under 35
U.S.C. 154(b) by 1176 days.

This patent is subject to a terminal dis-
claimer.

(21) Appl. No.: 17/595,637

(22) PCT Filed: May 19, 2020

(86) PCT No.: PCT/US2020/033563
§ 371 (c)(1),
(2) Date: Nov. 19, 2021

(87) PCT Pub. No.: WO2020/236795
PCT Pub. Date: Nov. 26, 2020

(65) Prior Publication Data
US 2022/0396631 A1      Dec. 15, 2022

Related U.S. Application Data

(60) Provisional application No. 62/854,667, filed on May
30, 2019, provisional application No. 62/850,889,
filed on May 21, 2019.

(51) Int. Cl.
*C07K 16/28* (2006.01)
*A61K 39/00* (2006.01)

(52) U.S. Cl.
CPC ...... *C07K 16/2878* (2013.01); *A61K 39/0011*
(2013.01); *A61K 39/001129* (2018.08); *C07K*
*16/2806* (2013.01); *C07K 16/2809* (2013.01);
*C07K 16/2824* (2013.01); *A61K 2039/507*
(2013.01); *C07K 2317/31* (2013.01); *C07K*
*2317/55* (2013.01); *C07K 2317/56* (2013.01);
*C07K 2317/622* (2013.01); *C07K 2317/73*
(2013.01)

(58) Field of Classification Search
CPC ............ C07K 16/2878; C07K 16/2806; C07K
16/2809; C07K 16/2824; C07K 2317/31;
C07K 2317/55; C07K 2317/56; C07K 2317/622; C07K 2317/73; C07K 2317/70;
A61K 39/0011; A61K 39/001129; A61K
2039/507; A61K 2039/505; A61K 39/395;
A61P 35/00
See application file for complete search history.

(56) References Cited

U.S. PATENT DOCUMENTS

| | | | |
|---|---|---|---|
| 4,676,980 | A | 6/1987 | Segal et al. |
| 5,169,938 | A | 12/1992 | Yoshida et al. |
| 5,547,853 | A | 8/1996 | Wallner et al. |
| 5,556,943 | A | 9/1996 | Yamashita et al. |
| 5,766,947 | A | 6/1998 | Rittershaus et al. |
| 5,777,084 | A | 7/1998 | Buhring |
| 5,798,229 | A | 8/1998 | Strittmatter et al. |
| 5,951,893 | A | 9/1999 | Bitko et al. |
| 5,951,983 | A | 9/1999 | Bazin et al. |
| 6,010,902 | A | 1/2000 | Ledbetter et al. |
| 6,011,138 | A | 1/2000 | Reff et al. |
| 6,849,258 | B1 | 2/2005 | Bazin et al. |

(Continued)

FOREIGN PATENT DOCUMENTS

| | | |
|---|---|---|
| CA | 2785907 A1 | 7/2011 |
| CA | 2925329 A1 | 10/2016 |

(Continued)

OTHER PUBLICATIONS

Law, et al. Preclinical and Nonclinical Characterization of HPN217:
A Tri-Specific T Cell Activating Construct (TriTAC) Targeting B
Cell Maturation Antigen (BCMA) for the Treatment of Multiple
Myeloma, Blood, vol. 132, Supplement 1, 2018, p. 3225, ISSN
0006-4971 (Year: 2017).*

(Continued)

*Primary Examiner* — Gregory S Emch
*Assistant Examiner* — Kathleen Cunningchen
(74) *Attorney, Agent, or Firm* — Biospark Intellectual
Property Law

(57) ABSTRACT

The present disclosure provides multispecific binding mol-
ecules that specifically bind to BCMA, a component of a
human T-cell receptor complex and either CD2 or a tumor
associated antigen, conjugates comprising the multispecific
binding molecules, and pharmaceutical compositions com-
prising the multispecific binding molecules and the conju-
gates. The disclosure further provides methods of using the
multispecific binding molecules to treat disease and disor-
ders associated with expression of BCMA. The disclosure
yet further provides recombinant host cells engineered to
express the multispecific binding molecules and methods of
producing the multispecific binding molecules by culturing
the host cells under conditions in which the multispecific
binding molecules are expressed.

Figure 1A:
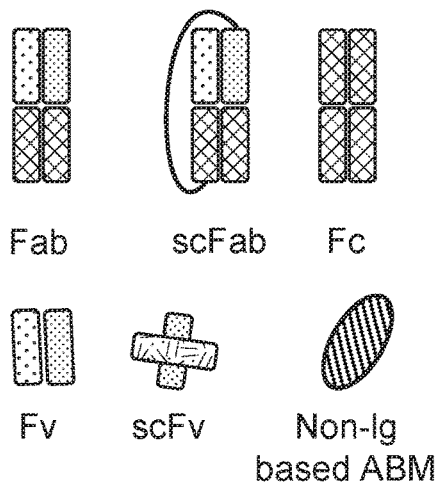

25 Claims, 10 Drawing Sheets
Specification includes a Sequence Listing.

(56) References Cited

U.S. PATENT DOCUMENTS

| | | | |
|---|---|---|---|
| 7,008,623 B1 | 3/2006 | Bonnefoy et al. |
| 7,138,496 B2 | 11/2006 | Hua et al. |
| 7,323,171 B2 | 1/2008 | Wallner et al. |
| 7,741,465 B1 | 6/2010 | Eshhar et al. |
| 7,887,798 B2 | 2/2011 | Gorczynski et al. |
| 8,236,308 B2 | 8/2012 | Kischel et al. |
| 8,329,178 B2 | 12/2012 | Marasco et al. |
| 8,340,621 B1 | 12/2012 | Husted |
| 8,362,211 B2 | 1/2013 | Elias et al. |
| 8,450,464 B2 | 5/2013 | Kuhne et al. |
| 8,536,310 B2 | 9/2013 | Abo et al. |
| 8,614,301 B2 | 12/2013 | Arber |
| 8,741,295 B2 | 6/2014 | Olive |
| 8,802,089 B2 | 8/2014 | Van Den Brink et al. |
| 8,852,551 B2 | 10/2014 | Jordan |
| 9,150,664 B2 | 10/2015 | Kufer et al. |
| 9,228,018 B2 | 1/2016 | Nadler et al. |
| 9,249,223 B2 | 2/2016 | Klinguer-Hamour et al. |
| 9,260,527 B2 | 2/2016 | Chambers et al. |
| 9,273,141 B2 | 3/2016 | Algate et al. |
| 9,289,509 B2 | 3/2016 | Osterroth et al. |
| 9,382,326 B2 | 7/2016 | Heusser et al. |
| 9,624,303 B2 | 4/2017 | Ohlfest et al. |
| 9,637,546 B2 | 5/2017 | Olive et al. |
| 9,650,446 B2 | 5/2017 | Moore et al. |
| 9,708,407 B2 | 7/2017 | Qiu et al. |
| 9,789,183 B1 | 10/2017 | Wang et al. |
| 10,647,768 B2 | 5/2020 | Johnson et al. |
| 10,913,803 B2 | 2/2021 | Bernett et al. |
| 11,492,409 B2 | 11/2022 | Abujoub et al. |
| 12,037,378 B2 | 7/2024 | Brannetti et al. |
| 12,221,481 B2 | 2/2025 | Granda et al. |
| 12,275,795 B2 * | 4/2025 | Abujoub ........... C07K 16/2878 |
| 2002/0002277 A1 | 1/2002 | Maliszewski et al. |
| 2002/0009446 A1 | 1/2002 | Magilavy |
| 2002/0168360 A1 | 11/2002 | Dingivan et al. |
| 2003/0044406 A1 | 3/2003 | Dingivan |
| 2003/0099642 A1 | 5/2003 | Yellin et al. |
| 2005/0175606 A1 | 8/2005 | Huang et al. |
| 2005/0244416 A1 | 11/2005 | Jung |
| 2005/0255110 A1 | 11/2005 | Lindhofer et al. |
| 2006/0115481 A1 | 6/2006 | Lindhofer et al. |
| 2006/0257398 A1 | 11/2006 | Hansen et al. |
| 2007/0071675 A1 | 3/2007 | Wu et al. |
| 2007/0212733 A1 | 9/2007 | Martin |
| 2007/0274998 A1 | 11/2007 | Utku |
| 2009/0297529 A1 | 12/2009 | Li et al. |
| 2010/0068136 A1 | 3/2010 | Hansen et al. |
| 2010/0104509 A1 | 4/2010 | King et al. |
| 2011/0054151 A1 | 3/2011 | Lazar et al. |
| 2012/0058906 A1 * | 3/2012 | Smider ............ A61P 9/10 506/17 |
| 2012/0171207 A1 | 7/2012 | Wilcox et al. |
| 2012/0195913 A1 | 8/2012 | Heusser et al. |
| 2012/0237442 A1 | 9/2012 | Rossi et al. |
| 2013/0156769 A1 | 6/2013 | Kufer et al. |
| 2013/0156770 A1 | 6/2013 | Kufer et al. |
| 2013/0295118 A1 | 11/2013 | Jiang et al. |
| 2014/0242077 A1 | 8/2014 | Choi et al. |
| 2014/0363426 A1 | 12/2014 | Moore et al. |
| 2015/0203580 A1 | 7/2015 | Papadopoulos et al. |
| 2015/0283178 A1 | 10/2015 | June et al. |
| 2016/0095938 A1 | 4/2016 | Fishkin et al. |
| 2016/0137730 A1 | 5/2016 | Abrams et al. |
| 2016/0297885 A1 | 10/2016 | Kuo et al. |
| 2016/0326249 A1 | 11/2016 | Ng et al. |
| 2016/0333095 A1 | 11/2016 | Van Den Brink et al. |
| 2016/0355600 A1 | 12/2016 | Moore et al. |
| 2016/0355608 A1 | 12/2016 | Bernett et al. |
| 2016/0368994 A1 | 12/2016 | Kelley et al. |
| 2017/0037128 A1 | 2/2017 | Little et al. |
| 2017/0204176 A1 | 7/2017 | Bonvini et al. |
| 2017/0204184 A1 | 7/2017 | Zha et al. |
| 2017/0209571 A1 | 7/2017 | Kanapuram et al. |
| 2017/0218077 A1 | 8/2017 | Raum et al. |
| 2017/0260271 A1 | 9/2017 | Igawa et al. |
| 2017/0368169 A1 | 12/2017 | Loew et al. |
| 2018/0118836 A1 | 5/2018 | Bernett et al. |
| 2018/0318417 A1 | 11/2018 | Schuetz et al. |
| 2019/0111079 A1 | 4/2019 | Mills |
| 2019/0112381 A1 | 4/2019 | Wesche et al. |
| 2019/0367628 A1 | 12/2019 | Abujoub et al. |
| 2020/0179511 A1 | 6/2020 | Daley et al. |
| 2020/0362054 A1 | 11/2020 | Granda et al. |
| 2021/0122805 A1 | 4/2021 | Camphausen et al. |
| 2021/0139585 A1 | 5/2021 | Granda et al. |
| 2021/0163620 A1 | 6/2021 | Granda et al. |
| 2022/0089752 A1 * | 3/2022 | Liu ................... C07K 16/2803 |
| 2022/0332821 A1 | 10/2022 | Aardalen et al. |
| 2022/0396631 A1 | 12/2022 | Granda et al. |
| 2023/0037682 A1 | 2/2023 | Granda et al. |
| 2023/0071196 A1 | 3/2023 | Brannetti et al. |
| 2023/0295322 A1 | 9/2023 | Abujoub et al. |
| 2024/0025993 A1 | 1/2024 | Cebe et al. |
| 2025/0223359 A1 | 7/2025 | Granda et al. |

FOREIGN PATENT DOCUMENTS

| | | | |
|---|---|---|---|
| CN | 101089180 A | 12/2007 |
| CN | 101636502 A | 1/2010 |
| CN | 101802010 A | 8/2010 |
| CN | 102250245 A | 11/2011 |
| CN | 104193806 A | 12/2014 |
| CN | 104450615 A | 3/2015 |
| CN | 104592393 A | 5/2015 |
| CN | 104788567 A | 7/2015 |
| CN | 104829726 A | 8/2015 |
| CN | 104829727 A | 8/2015 |
| CN | 105017422 A | 11/2015 |
| CN | 105777911 A | 7/2016 |
| CN | 106589129 A | 4/2017 |
| CN | 106939048 A | 7/2017 |
| CN | 107903324 A | 4/2018 |
| CN | 108264558 A | 7/2018 |
| CN | 108264559 A | 7/2018 |
| CN | 108659112 A | 10/2018 |
| CN | 109310755 A | 2/2019 |
| EP | 0180171 A2 | 5/1986 |
| EP | 0294703 A2 | 12/1988 |
| EP | 0336379 A2 | 10/1989 |
| EP | 276497 B1 | 10/1991 |
| EP | 276496 B1 | 3/1992 |
| EP | 0517174 A2 | 12/1992 |
| EP | 0637593 A1 | 2/1995 |
| EP | 0826696 A1 | 3/1998 |
| EP | 0497883 B1 | 7/1998 |
| EP | 0754230 B1 | 5/1999 |
| EP | 1666500 A1 | 6/2006 |
| EP | 1210425 B1 | 4/2007 |
| EP | 1223964 B1 | 4/2007 |
| EP | 2332994 A1 | 6/2011 |
| EP | 2361936 A1 | 8/2011 |
| EP | 2155783 B1 | 7/2013 |
| EP | 2762497 A1 | 8/2014 |
| EP | 2426148 B1 | 8/2015 |
| EP | 2493503 B1 | 8/2015 |
| EP | 3023437 A1 | 5/2016 |
| EP | 1806143 B1 | 6/2016 |
| EP | 2982694 B1 | 6/2016 |
| EP | 3029068 A1 | 6/2016 |
| EP | 2780374 B1 | 8/2019 |
| EP | 2780375 B1 | 9/2019 |
| JP | 2008-189678 A2 | 8/2008 |
| JP | 2012-211163 A2 | 11/2012 |
| JP | 2016-514463 A2 | 5/2016 |
| JP | 2017-519743 A2 | 7/2017 |
| RU | 2355705 C2 | 5/2009 |
| RU | 2014114179 A | 10/2015 |
| RU | 2577226 C2 | 3/2016 |
| RU | 2651776 C2 | 4/2018 |
| WO | 1988003565 A1 | 5/1988 |
| WO | 1988009820 A1 | 12/1988 |
| WO | 1989002922 A1 | 4/1989 |
| WO | 1991003493 A1 | 3/1991 |

(56) References Cited

FOREIGN PATENT DOCUMENTS

| | | | |
|---|---|---|---|
| WO | 1991006319 | A1 | 5/1991 |
| WO | 1991008298 | A2 | 6/1991 |
| WO | 1992016622 | A1 | 10/1992 |
| WO | 1995009917 | A1 | 4/1995 |
| WO | 1995024490 | A1 | 9/1995 |
| WO | 1996033217 | A1 | 10/1996 |
| WO | 1997008205 | A1 | 3/1997 |
| WO | 1999037791 | A1 | 7/1999 |
| WO | 1999054440 | A1 | 10/1999 |
| WO | 1999057150 | A2 | 11/1999 |
| WO | 2000006605 | A2 | 2/2000 |
| WO | 2000012113 | A2 | 3/2000 |
| WO | 2000018435 | A1 | 4/2000 |
| WO | 2000040716 | A2 | 7/2000 |
| WO | 2001012812 | A2 | 2/2001 |
| WO | 2001024811 | A1 | 4/2001 |
| WO | 2001077342 | A1 | 10/2001 |
| WO | 2001087977 | A2 | 11/2001 |
| WO | 2002020039 | A2 | 3/2002 |
| WO | 2002066516 | A2 | 8/2002 |
| WO | 2002072141 | A2 | 9/2002 |
| WO | 2003025018 | A2 | 3/2003 |
| WO | 2003062401 | A2 | 7/2003 |
| WO | 2003088998 | A1 | 10/2003 |
| WO | 2003090513 | A2 | 11/2003 |
| WO | 2004011611 | A2 | 2/2004 |
| WO | 2004035752 | A2 | 4/2004 |
| WO | 2004106381 | A1 | 12/2004 |
| WO | 2004106383 | A1 | 12/2004 |
| WO | 2004108158 | A1 | 12/2004 |
| WO | 2005035586 | A1 | 4/2005 |
| WO | 2005040220 | A1 | 5/2005 |
| WO | 2005052004 | A2 | 6/2005 |
| WO | 2005061547 | A2 | 7/2005 |
| WO | 2005075511 | A1 | 8/2005 |
| WO | 2005077982 | A1 | 8/2005 |
| WO | 2005095456 | A1 | 10/2005 |
| WO | 2005108986 | A1 | 11/2005 |
| WO | 06053301 | A2 | 5/2006 |
| WO | 2006067210 | A1 | 6/2006 |
| WO | 2006089133 | A2 | 8/2006 |
| WO | 2006133450 | A2 | 12/2006 |
| WO | 2007002223 | A2 | 1/2007 |
| WO | 2007042261 | A2 | 4/2007 |
| WO | 2007068354 | A1 | 6/2007 |
| WO | 2008119565 | A2 | 10/2008 |
| WO | 2008119566 | A2 | 10/2008 |
| WO | 2008119567 | A2 | 10/2008 |
| WO | 2009007124 | A1 | 1/2009 |
| WO | 2009018386 | A1 | 2/2009 |
| WO | 2009030734 | A1 | 3/2009 |
| WO | 2009070642 | A1 | 6/2009 |
| WO | 2009080829 | A1 | 7/2009 |
| WO | 2009132058 | A2 | 10/2009 |
| WO | 2010007082 | A1 | 1/2010 |
| WO | WO2010021697 | A2 | 2/2010 |
| WO | 2010027797 | A1 | 3/2010 |
| WO | 2010035012 | A1 | 4/2010 |
| WO | 2010037835 | A2 | 4/2010 |
| WO | 2010037836 | A2 | 4/2010 |
| WO | 2010037837 | A2 | 4/2010 |
| WO | 2010037838 | A2 | 4/2010 |
| WO | 2010052013 | A1 | 5/2010 |
| WO | 2010053716 | A1 | 5/2010 |
| WO | 2010104949 | A2 | 9/2010 |
| WO | 2010132659 | A2 | 11/2010 |
| WO | 2011051307 | A1 | 5/2011 |
| WO | 2011070109 | A1 | 6/2011 |
| WO | 2011076922 | A1 | 6/2011 |
| WO | 2011089211 | A1 | 7/2011 |
| WO | 2011090762 | A1 | 7/2011 |
| WO | 2012055961 | A1 | 5/2012 |
| WO | 2012062596 | A1 | 5/2012 |
| WO | 2012064792 | A2 | 5/2012 |
| WO | 2012066058 | A1 | 5/2012 |
| WO | WO2012055058 | A1 | 5/2012 |
| WO | 2012079000 | A1 | 6/2012 |
| WO | 2012118622 | A1 | 9/2012 |
| WO | 2012143498 | A1 | 10/2012 |
| WO | 2012158818 | A2 | 11/2012 |
| WO | 2012162067 | A2 | 11/2012 |
| WO | 2012162561 | A1 | 11/2012 |
| WO | 2012163805 | A1 | 12/2012 |
| WO | 2013026833 | A1 | 2/2013 |
| WO | 2013026839 | A1 | 2/2013 |
| WO | 2013055809 | A1 | 4/2013 |
| WO | 2013063702 | A1 | 5/2013 |
| WO | 2013072406 | A1 | 5/2013 |
| WO | 2013072415 | A1 | 5/2013 |
| WO | 2013154760 | A1 | 10/2013 |
| WO | 2014011521 | A1 | 1/2014 |
| WO | 2014012085 | A2 | 1/2014 |
| WO | 2014025198 | A2 | 2/2014 |
| WO | 2014028560 | A2 | 2/2014 |
| WO | 2014031687 | A1 | 2/2014 |
| WO | 2014051433 | A1 | 4/2014 |
| WO | 2014068079 | A1 | 5/2014 |
| WO | 2014089335 | A2 | 6/2014 |
| WO | 14110601 | A1 | 7/2014 |
| WO | 2014110601 | A1 | 7/2014 |
| WO | 2014116846 | A2 | 7/2014 |
| WO | 2014122143 | A1 | 8/2014 |
| WO | 2014122144 | A1 | 8/2014 |
| WO | 2014124280 | A1 | 8/2014 |
| WO | 2014130635 | A1 | 8/2014 |
| WO | 2014131694 | A1 | 9/2014 |
| WO | 2014138819 | A1 | 9/2014 |
| WO | 2014140248 | A1 | 9/2014 |
| WO | 2014144600 | A2 | 9/2014 |
| WO | 2014153270 | A1 | 9/2014 |
| WO | WO2014145806 | A2 | 9/2014 |
| WO | 2015006749 | A2 | 1/2015 |
| WO | 2015013671 | A1 | 1/2015 |
| WO | WO2015001085 | A1 | 1/2015 |
| WO | 2015052538 | A1 | 4/2015 |
| WO | 2015095392 | A1 | 6/2015 |
| WO | 2015095412 | A1 | 6/2015 |
| WO | 2015109131 | A2 | 7/2015 |
| WO | WO2015104346 | A1 | 7/2015 |
| WO | 2015142675 | A2 | 9/2015 |
| WO | 2015149077 | A1 | 10/2015 |
| WO | 2015166073 | A1 | 11/2015 |
| WO | 2015174439 | A1 | 11/2015 |
| WO | 2015181683 | A1 | 12/2015 |
| WO | 2015184203 | A1 | 12/2015 |
| WO | 2015184207 | A1 | 12/2015 |
| WO | 2016004108 | A2 | 1/2016 |
| WO | 2016011571 | A1 | 1/2016 |
| WO | 2016014565 | A2 | 1/2016 |
| WO | 2016014789 | A2 | 1/2016 |
| WO | 2016014974 | A2 | 1/2016 |
| WO | 2016019969 | A1 | 2/2016 |
| WO | 2016020065 | A1 | 2/2016 |
| WO | 2016020322 | A1 | 2/2016 |
| WO | 2016023909 | A1 | 2/2016 |
| WO | 2016028896 | A1 | 2/2016 |
| WO | 2016036937 | A1 | 3/2016 |
| WO | 2016048938 | A1 | 3/2016 |
| WO | 2016054450 | A1 | 4/2016 |
| WO | 2016075670 | A1 | 5/2016 |
| WO | 2016079177 | A1 | 5/2016 |
| WO | 16086196 | A2 | 6/2016 |
| WO | 16090327 | A2 | 6/2016 |
| WO | 16105450 | A2 | 6/2016 |
| WO | 2016086186 | A2 | 6/2016 |
| WO | 2016086189 | A2 | 6/2016 |
| WO | 2016086196 | A2 | 6/2016 |
| WO | 2016087245 | A1 | 6/2016 |
| WO | 2016094304 | A2 | 6/2016 |
| WO | 2016115274 | A1 | 7/2016 |
| WO | 2016130598 | A1 | 8/2016 |
| WO | 2016146702 | A1 | 9/2016 |
| WO | 2016154623 | A2 | 9/2016 |
| WO | 2016166629 | A1 | 10/2016 |

(56) References Cited

FOREIGN PATENT DOCUMENTS

| WO | 2016166630 A1 | 10/2016 |
| WO | 2016174652 A1 | 11/2016 |
| WO | 2016179003 A1 | 11/2016 |
| WO | 2016179518 A2 | 11/2016 |
| WO | 2016182751 A1 | 11/2016 |
| WO | 2016187594 A1 | 11/2016 |
| WO | 2017008169 A1 | 1/2017 |
| WO | 2017014679 A2 | 1/2017 |
| WO | 17021450 A1 | 2/2017 |
| WO | 17031104 A1 | 2/2017 |
| WO | 2017023779 A1 | 2/2017 |
| WO | 2017027392 A1 | 2/2017 |
| WO | 2017040344 A2 | 3/2017 |
| WO | 2017053856 A1 | 3/2017 |
| WO | 2017055314 A1 | 4/2017 |
| WO | WO2017055328 A1 | 4/2017 |
| WO | WO2017055541 A1 | 4/2017 |
| WO | 2017079121 A2 | 5/2017 |
| WO | 2017079272 A2 | 5/2017 |
| WO | 2017086367 A1 | 5/2017 |
| WO | 2017091656 A1 | 6/2017 |
| WO | 2017095267 A1 | 6/2017 |
| WO | 2017096368 A1 | 6/2017 |
| WO | 2017103895 A1 | 6/2017 |
| WO | 2017125897 A1 | 7/2017 |
| WO | 17134134 A1 | 8/2017 |
| WO | 2017136562 A2 | 8/2017 |
| WO | 2017136659 A2 | 8/2017 |
| WO | 2017142928 A1 | 8/2017 |
| WO | 2017157305 A1 | 9/2017 |
| WO | 2017165464 A1 | 9/2017 |
| WO | 2017186928 A1 | 11/2017 |
| WO | 2017189959 A1 | 11/2017 |
| WO | 17223111 A1 | 12/2017 |
| WO | 2018014001 A1 | 1/2018 |
| WO | 2018017786 A2 | 1/2018 |
| WO | 2018022957 A1 | 2/2018 |
| WO | 18083204 A1 | 5/2018 |
| WO | 18119215 A1 | 6/2018 |
| WO | 2018099978 A1 | 6/2018 |
| WO | 2018107125 A1 | 6/2018 |
| WO | 18133877 A1 | 7/2018 |
| WO | 18151836 A1 | 8/2018 |
| WO | 2018166468 A1 | 9/2018 |
| WO | 2018178047 A1 | 10/2018 |
| WO | 2018188612 A1 | 10/2018 |
| WO | 2018191438 A1 | 10/2018 |
| WO | 18201051 A1 | 11/2018 |
| WO | 18204907 A1 | 11/2018 |
| WO | 2018199593 A1 | 11/2018 |
| WO | 2018201047 A1 | 11/2018 |
| WO | 18237006 A1 | 12/2018 |
| WO | 18237037 A2 | 12/2018 |
| WO | 2018237341 A1 | 12/2018 |
| WO | 19001474 A1 | 1/2019 |
| WO | 2019005639 A2 | 1/2019 |
| WO | 2019005641 A1 | 1/2019 |
| WO | 19035938 A1 | 2/2019 |
| WO | 2019057122 A1 | 3/2019 |
| WO | 2019057124 A1 | 3/2019 |
| WO | 19075359 A1 | 4/2019 |
| WO | 19075378 A1 | 4/2019 |
| WO | 19077062 A1 | 4/2019 |
| WO | 2019070047 A1 | 4/2019 |
| WO | 2019078697 A2 | 4/2019 |
| WO | 2019089969 A2 | 5/2019 |
| WO | 2019104075 A1 | 5/2019 |
| WO | 2019195535 A1 | 10/2019 |
| WO | 2019229701 A2 | 12/2019 |
| WO | 2020052692 A2 | 3/2020 |
| WO | 2020236792 | 11/2020 |
| WO | 2020236795 A2 | 11/2020 |
| WO | 2020236797 A1 | 11/2020 |
| WO | WO2020261093 A1 | 12/2020 |
| WO | 2021195513 A1 | 9/2021 |

OTHER PUBLICATIONS

Gantke T, et al. Trispecific antibodies for CD16A-directed NK cell engagement and dual-targeting of tumor cells. Protein Eng Des Sel. Sep. 1, 2017;30(9):673-684. doi: 10.1093/protein/gzx043. (Year: 2017).*

Moore et al., Application of dual affinity retargeting molecules to achieve optimal redirected T-cell killing of B-cell lymphoma. Blood 2011; 117 (17): 4542-4551. doi: https://doi.org/10.1182/blood-2010-09-306449 (Year: 2011).*

Tutt, A., et al., 1991. Trispecific F (ab') 3 derivatives that use cooperative signaling via the TCR/CD3 complex and CD2 to activate and redirect resting cytotoxic T cells. Journal of immunology, 147(1), pp. 60-69 (Year: 1991).*

Bellucci et al., "Complete response to donor lymphocyte infusion in patients with multiple myeloma is associated with antibody response to BCMA, a plasma cell membrane receptor", Blood, 102(11):192a-193a (Year: 2003).*

Zhao, et al., 2018, "A phase 1, open-label study of LCAR-B38M, a chimeric antigen receptor T cell therapy directed against B cell maturation antigen, in patients with relapsed or refractory multiple myeloma," Journal of Hematology & Oncology 11(141) 16 pages.

Aggregate. (n.d.) accessed Aug. 8, 2023; dic.academic.ru/dic.nsf/ushakov/1033406 (2 pages).

Dondelinger et al., 2018, "Understanding the Significance and Implications of Antibody Numbering and Antigen-Binding Surface/Residue Definition," Frontiers in Immunology 9(2278): 1-16.

Gonzales et al., 2005, "Minimizing the Immunogenicity of Antibodies for Clinical Application," Tumor Biol. 26: 31-43.

International Search Report and Written Opinion for International Application No. PCT/US2020/033559, dated Oct. 14, 2020.

International Search Report and Written Opinion issued in PCT/CN2019/122876 on Mar. 13, 2020.

International Search Report and Written Opinion issued in PCT/IB2020/055872 on Sep. 24, 2020.

International Search Report and Written Opinion issued in PCT/US2020/033566 on Sep. 22, 2020.

International Search Report and Written Opinion of the International Searching Authority for International Application No. PCT/US2018/062078, dated Mar. 25, 2019.

International Search Report Written Opinion issued in PCT/US2020/033563 on Jul. 29, 2020.

Klausen, et al., 2018, "Cancer immune therapy for lymphoid malignancies: recent advances," Seminars in Immunopathology https://doi.org/10.1007/s00281-018-0696-7 (14 pages).

Kunik et al., 2012, "Structural Consensus among Antibodies Defines the Antigen Binding Site," PLoS Computational Biology 8(2): e1002388.

Lu et al., 2005, "A Fully Human Recombinant IgG-like Bispecific Antibody to Both the Epidermal Growth Factor Receptor and the Insulin-like Growth Factor Receptor for Enhanced Antitumor Activity," The Journal of Biological Chemistry 280(20): 19665-19672.

Panka, et al., 1988, "Variable region framework differences result in decreased or increased affinity of variant anti-digoxin antibodies," Proc. Natl. Acad. Sci. USA 85: 3080-3084.

Sela-Culang et al., 2013, "The structural basis of antibody-antigen recognition," Frontiers in Immunology 4(302): 1-13.

Vishwasrao, P., 2020, "Characterization of a Bispecific BAFF-R X CD3 antibody for the treatment of Lymphoma," Developing Insights (abstract only).

Wark and Hudson, 2006, "Latest technologies for the enhancement of antibody affinity," Advanced Drug Delivery Reviews 58: 657-670.

Chen et al., 1992, "Generation and Analysis of Random Point Mutations in an Antibody CDR2 Sequence: Many Mutated Antibodies Lose Their Ability to Bind Antigen," J. Exp. Med. 176: 855-866.

Hall et al., 1992, "A Single Amino Acid Mutation in CDR3 of the 3-14-9 L Chain Abolished Expression of the IDA 10-Defined Idiotope and Antigen Binding," J. Immunol. 149: 1605-1612.

Holt et al., 2003, "Domain antibodies: protein for therapy," Trends in Biotechnology 21: 484-490.

(56) References Cited

OTHER PUBLICATIONS

NCBI Accession No. AAC51019.1, Immunoglobulin Heavy Chain Variable Region, Partial [*Homo sapiens*] (Feb. 18, 1997).
Rabia et al., 2018, "Understanding and overcoming trade-offs between antibody affinity, specific, stability and solubility," Biochem. Eng J. 137: 365-374.
Vu et al., 2015, "A New Class of T-Cell Bispecific Antibodies for the Treatment of Multiple Myeloma Binding to B Cell Maturation Antigen and CD3 and Showing Potent, Specific Antitumor Activity in Myeloma Cells and Long Duration of Action in Cynomolgus Monkeys" Blood, 126(23):2998.
Ryan et al., Antibody targeting of B-cell maturation antigen on malignant plasma cells, Mol Cancer Ther, 6 11:3009-3018 (2007).
Konterman, "Invited review—Recombinant bispecific antibodies for cancer therapy", Acta Pharmacologica Sinica 26 (1):1-9 (2005).
Novak et al., "Expression of BCMA, TACI, and BAFF-R in multiple myeloma: a mechanism for growth and survival", Blood, 103(2):689-694 (2004).
Genbank accession No. AB052772 "*Homo sapiens* gene for BCMA, complete cds".
Fitzgerald et al., "The Cytokine FactsBook", 2nd ed., Academic Press, pp. 151-152 (2001).
Bossen et al., "Review—BAFF, APRIl and their receptors: Structure, function and signaling", Seminars in Immunology, 18:263-275 (2006).
Bodmer et al., "Review—The molecular architecture of the TNF superfamily", Trends in Biochemical Sciences, 27 (1):19-26 (2002).
Hymowitz et al., "Structures of APRIL—Receptor Complexes", Journal of Biological Chemistry, 280(8):7218-7227 (2005).
Liu et al., "Ligand-receptor binding revealed by the TNF family member TALL-1", Nature, 423:49-56 (2003).
Wallweber et al., "The Crystal Structure of a Proliferation-inducing Ligand, APRIL", 343:283-290 (2004).
Patel et al., "Engineering an APRIL-specific B-Cell Maturation Antigen", Journal of Biological Chemistry, 279 (16): 16727-16735 (2004).
Vidal-Laliena et al., "Characterization of antibodies submitted to the B-cell section of the 8th human leukocyte differentiation antigens workshop by flow cytometry and immunohistochemistry", 236:6-16 (2005).
Moreaux et al., "APRIL and TACI interact with syndecan-1 on the surface of multiple myeloma cells to form an essential survival loop", Eur J Heamatol, 83:119-129 (2009).
Bellucci et al., "Graft-versus-tumor response in patients with multiple myeloma is associated with antibody response to BCMA, a plasma-cell membrane receptor", Blood, 105(10):3945-3950 (2005).
Bellucci et al., "complete response to donor lymphocyte infusion in multiple myeloma is associated with antibody responses to highly expressed antigens", Blood, 103(3):656-663 (2004).
Leiba et al., "Activation of B-cell maturation antigen (BCMA) on human multiple myeloma cells by a proliferation-inducing-ligand (APRIL) promotes myeloma cell function in the bone marrow microenvironment", Blood, 110(11):1503 (2007).
Tarte et al., "BAFF is a survival factor for multiple myeloma cells", Myeloma Biology II, p. 811a (#3203) (2002).
Dillon et al., "an APRIL to remember: Novel TNF ligands as therapeutic targets", Nat ev, 5:235-246 (2006).
Betts et al., "Amino Acid Properties and Consequences of Substitutions", Bioinformatics for Geneticists, pp. 289-316 (2003).
Choi et al., "Bispecific antibodies engage T-cells for antitumor immunotherapy", Expert Opinion on Biological Therapy, 11(7):843-853 (2011).
Muller et al., "Bispecific antibodies for cancer immunotherapy", Biodrugs, 24(2):89-98 (2010).
Thakur et al., "Cancer therapy with bispecific antibodies: Clinical experience", Current Opinion in Molecular Therapeutics, 12(3):340-349 (2010).
Chames et al., "Bispecific antibodies for cancer therapy", Current Opinion in Drug Discovery & Development, 12 (2):276-283 (2009).

Baeuerle et al., "Bispecific T-cell engaging antibodies for cancer therapy", Cancer Research, 69(12):4941-4944 (2009).
Baeuerle et al., "BITE: Teaching antibodies to engage T-cells for cancer therapy", Current Opinion in Molecular Therapeutics, 11(1):22-30 (2009).
Baeuerle et al., "Bite: A new class of antibodies that recruit T-cells", Drugs of the Future, 33(2):137-147 (2008).
Muller et al., "Recombinant bispecific antibodies for cellular cancer immunotherapy", Current Opinion in Molecular Therapeutics, 9(4):319326 (2006).
Kufer et al., "Review—A revival of bispecific antibodies", Trends in Biotechnology, 22(5):238-244 (2004).
Frank, "specificity and Cross-Reactivity", Immunology and evolution of infectious diseases textbook, Chapter 4, pp. 33-56 (2002).
GenBank accession No. NM_000733, "*Homo sapiens* CD3e molecule (CD3E), mRNA".
Panowski et al., "Preclinical efficacy and safety comparison of CD3 bispecific and ADC modalities targeting BCMA for the treatment of multiple myeloma", AACR, pp. OF1-OF13 (2019).
Hager-Braun et al., Expert Rev. Proteomics, 2(5):745-756 (2005).
Rennert et al., J. Exp. Med., 192(11):1677-1683 (2000).
Kuhns et al., Immunity, 24:133-139 (2006).
Koarada et al., Rheumatology, 49:662-670 (2010).
Pelekanou et al., BMC Cancer, 8(76):1-9 (2008).
Guy and Vignali, Immunol Rev., 232(1):1-22 (2009).
Kjer-Nielsen et al., Proceedings of the National Academy of Sciences, 11:7675-7680 (2004).
Chames et al., mAbs, 1:539-547 (2009).
Clayton et al., Proceedings of the National Academy of Sciences USA, 88:5202-5206 (1991).
Neisig et al., Journal of Immunology, 151:870-879 (1993).
Bargou et al. Science, 321:974-977 (2008).
Honemann et al., Leukemia, 18:636-644 (2004).
Kontermann, Roland, "Bispecific Antibodies," 2011.
Hipp et al: "A novel BCMA/CD3 bispecific T-cell engager for the treatment of multiple myeloma induces selective lysis in vitro and in vivo", Leukemia, vol. 31, No. 8, Dec. 27, 2016 (Dec. 27, 2016), pp. 1743-1751, XP055547607, ISSN: 0887-6924, DOI: 10.1038/1eu.2016.388.
Buelow et al: "T Cell Engagement without Cytokine Storm: A Novel Bcma x CD3 Antibody Killing Myeloma Cells with Minimal Cytokine Secretion", Blood, vol. 130, No. Suppl. 1, Dec. 7, 2017 (Dec. 7, 2017), p. 501, XP009516261, & 59th Annual Meeting of the American-Society-Ofhematology (Ash).
Buelow et al: "Development of a fully human T cell engaging bispecific antibody for the treatment of multiple myeloma", The Patent Office p. 2 of 8 3 Jun. 2, 2017 (Jun. 2, 2017), p. 1, XP055476656, Retrieved from the Internet: URL:http://www.teneobio.com/wpcontent/uploads/2018/01/Poster_I.pdf.
Girgis et al: "Exploratory Pharmacokinetic/Pharmacodynamic and Tolerability Study of BCMAxCD3 in Cynomolgus Monkeys", Blood, vol. 128, No. 22, Dec. 2, 2016 (Dec. 2, 2016), p. 5668, XP009516262, & 58th Annual Meeting and Exposition of the American-Society-Ofhematology (Ash); San Diego.
Rudikoff et al: "Single amino acid substitution altering antigen-binding specificity", Proceedings of the National Academy of Sciences (PNAS), US, vol. 79, No. 6, Mar. 1, 1982 (Mar. 1, 1982), pp. 1979-1983, XP002683593, ISSN: 0027-8424, DOI: 10.1073/PNAS.79.6.1979.
Ansari et al., "Decreased expression of B cell maturation antigen in patients with common variable immunodeficiency," Ped Allergy Immunol Pulm 30(1): 7-13, 2017 (abstract only).
Biorad mini review, "Overview of T cell Receptors", 2016, (www.bio-rad-antibodies.com/t-cell-receptor-minireview.html; accessed Aug. 6, 2021).
Definition of "Component", www.merriam-webster.com/dictionary/component (accessed Aug. 6, 2021).
Definition of "Medicament", www.merriam-webster.com/dictionary/medicament (accessed Aug. 5, 2021).
Dogan et al., "B-cell maturation antigen expression across hematologic cancers: a systemic literature review," Blood Cancer J 10: 73, 2020 (13 total pages).

(56)         References Cited

OTHER PUBLICATIONS

Lee et al., "Evaluation of B cell maturation antigen as a target for antibody drug conjugate mediated cytotoxicity in multiple myeloma," Brit J Haematol 17 4: 911-922, 2016.

Rossi et al., "Antibody-drug conjugates for the treatment of hematalogical malignancies: a comprehensive review," Targeted Oneal 13 : 287-308, 2018.

Tai et al., "Novel anti-B cell maturation antigen antibody-drug conjugate (GSK2857916) selectively induces killing of multiple myeloma," Blood 123(20): 3128-3138, 2014.

Tai et al., "APRIL and BCMA promote human multiple myeloma growth and immunosuppression in the bone marrow microenvironment," Blood 127(25): 3225-3236, 2016.

Viardot et al., "Bispecific antibodies in haematological malignancies," Cancer Treatment Rev 65: 87-95, 2018.

Gantke et al., 2017, "Trispecific antibodies for CD16A-directed NK cell engagement and dual-targeting of tumor cells," Protein Engineering Design and Selection 30(9):673-684.

Law et al., 2018, "Preclinical and nonclinical characterization of HPN217: a tri-specific T cell activating construct (TriTAC) targeting B cell maturation antigen (BCMA) for the treatment of multiple myeloma," Blood 132:3225.

Office Action issued Oct. 6, 2023 in RU application No. 2021133487 (English translation).

Aigner et al., 2013, "T lymphocytes can be effectively recruited for ex vivo and in vivo lysis of AML blasts by a novel CD33/CD3-bispecific BiTE antibody construct" Leukemia, 27: 1107-1115.

Atwell et al., 1997, "Stable Heterodimers from Remodeling the Domain Interface of a Homodimer using a Phage Display Library" J. Mol. Biol. 270:26-35.

Badri et al., 2016, "Optimization of radiation dosing schedules for proneural glioblastoma" Mathematical Biology 72:1301-1336.

Baylot et al., 2017, "TCTP Has a Crucial Role in the Different Stages of Prostate Cancer Malignant Progression" Results and Problems in Cell Differentiation 64:255-261.

Bendig M. 1995 "Humanization of Rodent Monocloanl Antibodies by CDR Grafting" Methods: A Companion to Methods in Enzymology 8:83-93.

Bork, 2000, "Powers and Pitfalls in Sequence Analysis: The 70% Hurdle," Genome Research 10:398-400.

Brinkman et al., 2017, "The making of bispecific antibodies" MABS, 9(2):182-212.

Bross et al., 2001, ""Approval Summary: Gemtuzumab Ozogamicin in Relapsed Acute Myeloid Leukemia"" Clinical Cancer Research, 7(6):1490-1496.

Brossay et al., "Porcine CD58: cDNA cloning and molecular dissection of the porcine CD58-human CD2 interface," Biochem Biophys Res Commun. Oct. 3, 2003;309(4):992-8.

Brown et al., 1996, "Tolerance to Single, but Not Multiple, Amino Acid Replacements in Antibody Vh CDR2," J. Immunol., 156:3285-3291.

Burgess et al., 1990, "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue" Journal of Cell Biology 111:2129-2138.

Caron et al., 1992, "Biological and Immunological Features of Humanized M195 (Anti-CD33) Monoclonal Antibodies" Cancer Research, 52:6761-6767.

Carter, P., 2001, "Bispecific human IgG by design," Journal of Immunological Methods 248 (1-2): 7-15.

Castella, et al. "Development of a Novel Anti-CD19 Chimeric Antigen Receptor: A Paradigm for an Affordable CAR T Cell Production at Academic Institutions" Molecular Therapy, Methods & Clinical Development, Mar. 1, 2019, vol. 12, pp. 134-144.

Chen et al., 2013 "Molecular mechanisms of T cell co-stimulation and co-inhibition" Nat Rev Immunol 13(4):227-42.

Chiu et al., 2019 "Antibody Structure and Function: The Basis for Engineering Therapeutics" Antibodies 8(4):55.

Cienfuegos et al., 2016, "Intramolecular trimerization, a novel strategoy for making multispecific antibodies with controlled orientation of the antigen binding domains" Sci Rep 6,28643.

D'Argouges et al., 2009 "Combination of rituximab with blinatumomab (MT103/MEDI-538), a T cell-engaging CD19/CD3-bispecific antibody, for highly efficient lysis of human B lymphoma cells" Leukemia Research 33:465-473.

Database UniProt (Online) May 8, 2019, "SubName: Full-CD58 molecule {ECO:0000313 Ensembl: ENSNLEP00000040453};", XP002799714, retrieved from EBI accession No. Uniprot: A0A213H9Z0, Database accession No. A0A2I3H9Z0.

Dermer G.B., Another Anniversary for the War on Cancer, Bio/ Technology, Mar. 1, 1994, vol. 12.

Dombkowski, et al., 2014, "Protein disulfide engineering," FEBS Letters 588(2):206-212.

Dubel, 2007, Handbook of Therapeutic Antiboides 100-101.

Dutour et al., 2012, ""In Vitro and In Vivo Antitumor Effect of Anti-CD33 Chimeric Receptor-Expressing EBV-CTL against CD33+ AcuteMyeloid Leukemia"" Advances in Hematology, 683065.

Fesnak et al., 2016, "Engineered T cells: the promise and challenges of cancer immunotherapy" Nature Reviews 16:566-581.

Greenspan et al., 1999, "Defining epitopes: It's not as easy as it seems," Nature Biotechnology, 17:936-937.

Groen et al., 2010, "In Vitro and In Vivo Efficacy of CD38 Directed Therapy with Daratumumab in the Treatment of Multiple Myeloma" Blood, 116(21):3058.

Haso et al., 2013, ""Anti-CD22-chimeric antigen receptors targeting B-cell precursor acute lymphoblastic leukemia"" Blood , 121(7):1165-1174.

International Search Report for International Application No. PCT/ US2019/025760, dated Jun. 19, 2019.

Johnson and Wu, 2004 "The Kabat Database and a Bioinformatics Example" Methods in Molecular Biology, Antibody Engineering: Methods and Protocols, 248 (11-25).

Kato et al., 2013, "Efficacy of a CD22-targeted antibody-saporin conjugate in a xenograft model of precursor-B cell acute lymphoblastic leukemia" Leukemia Research, 37(1): 83-88.

Keren et al., 2011 "B-cell depletion reactivates B lymphopoiesis in the BM and rejuvenates the B lineage in aging" Blood 117(11):3104-3112.

Kijanka et al., 2015, "Nanobody-based cancer therapy of solid tumors," Nanomedicine 10(1):161-174.

Kingma et al., 2002, "CD2 Is Expressed by a Subpopulation of Normal B Cells and Is Frequently Present in Mature B-Cell Neoplasms" Cytometry 50:243-248.

Klein et al., 2016, "The use of CrossMAb technology for the generation of bi- and multispecific antibodies" MABS 8 (6):1010-1020.

Kontermann et al., 2015, "Bispecific Antibodies" Drug Discovery Today, 20(7).

Kuegler et al., "A recombinant trispecific single-chain Fv derivative directed against CD123 and CD33 mediates effective elmination of acute myeloid leukaemia cells by dual targeting" British Journal of Haematology, Sep. 1, 2010, vol. 150, No. 5, pp. 574-586.

Kulmanov et al., 2018, "DeepGO: predicting protein functions from sequence and interations using a deep ontology-aware classifier," Bioinformatics 34(4):660-668.

Kuznetsova, 2015, Brackets in Text of Legal Documents as a Linguocognitive Phenomenon, Journal of Moscow Region State University, Russian Philology Series, N3:37-43.

Lapusan et al., 2012, "Phase I studies of AVE9633, an anti-CD33 antibody-maytansinoid conjugate, in adult patients with relapsed/ refractory acute myeloid leukemia" Invest New Drugs, 30(3):1121-31.

Lazar et al., 1988, "Transforming Growth Factor alpha: Mutation of Aspartic Acid 47 and Leucine 48 Results in Different Biological Activities" Molecular and Cellular Biology 8:1247-1252.

Leitner 2010, "Receptors and ligands implicated in human T cell costimulatory processes" Immunol Lett. 128(2):89-97.

Leitner et al., 2015 "CD58/CD2 Is the Primary Costimulatory Pathway in Human CD28-CD8+ T Cells" J Immunol 195 (2):477-87.

(56) References Cited

OTHER PUBLICATIONS

Leong et al., 2017, ""An anti-CD3/anti-CLL-1 bispecific antibody for the treatment of acute myeloid leukemia"" Blood, 129(5):609-618.

Littlehales, 2009, "Willem 'Pim' Stemmer" Nature Biotechnology 27(3):220.

Lu et al., 2014, "Targeting Human C-Type Lectin-Like Molecule-1 (CLL1) with a Bispecific Antibody for Acute Myeloid Leukemia Immunotherapy" Angew Chem Int Ed, 53(37):9841-9845.

Lu et al., 2017 "Research Progress on Relationship between CD58 Molecule and All and Lymphoma," Journal of Experimental Hematology 25(2): 592-595.

Lu et al., 2022, "A Phase 1 Study of PIT565, a First-in-Class, Anti-CD3, Anti-CD19, Anti-CD2 Trispecific Antibody in Patients with Relapsed and/or Refractory B-Cell Malignancies" Blood, 140 (Supplement 1): 3148.

Mariuzza et al., 1987, "The structrual basis of antigen-antibody recognition, " Annu Rev Biophys Chem; 16:139-59.

Miller et al., 1993, ""99. Specific interaction of lymphocyte function-associated antigen 3 with CD2 can inhibit T cell responses,"" J. Exp. Med 178(1):211-222.

Mintz and Crea, 2013, "Protein scaffolds: The next generation of protein therapeutics?" Bioprocess International 11 (2):40-48.

Miosge et al., 2015, "Comparison of predicted and actual consequences of missense mutations," Proc Natl Acad Sci 112(37):E5189-98.

Molhoj et al., 2007, "CD19-/CD3-bispecific antibody of the BiTE class is far superior to tandem diabody with respect to redirected tumor cell lysis" Molecular Immunology 44:1935-1943.

Muller et al., 2008, "Spliceosomal Peptide P140 for Immunotherapy of Systemic Lupus Erythematosus" Arthritis & Rheumatism 58(12):3873-3883.

Pan et al., 2007, "Blocking neuropilin-1 function has an additive effect with anti-VEGF to inhibit tumor growth" Cancer Cell 11(1):53-67.

Paul 1993, "Fundamental Immunology" 3:292-295.

Pizzitola et al., 2014, "Chimeric antigen receptors against CD33/CD123 antigens efficiently target primary acute myeloid leukemia cells in vivo" Leukemia, 28: 1596-1605.

Plurality. (n.d.) accessed Aug. 8, 2023:https://dic.academic.ru/dic.nsf/ushakov/1033406.

Qin et al., 2019 "CAR T cells targeting BAFF-R can overcome CD19 antigen loss in B cell malignancies" Sci Transl Med 11(511).

Quintero-Hernandez et al., 2007, "The change of the scFv into Fab format improves the stability and in vivo toxin neutralization capacity of recombinant antibodies" Molecular Immunology 44:1307-1315.

Sable et al., 2016 "Constrained Cyclic Peptides as Immunomodulatory Inhibitors of the CD2:CD58 Protein-Protein Interaction" ACS Chem Biol, 11: 2366-2374.

Schlehuber & Skerra, 2001, "Duocalins: engineered ligan-binding proteins with dual specificity derived from the lipocalin fold," Biol Chem. 382(9): 1335-42 (abstract only).

Schoonjans et al., 2000, "Fab chains as an efficient heterodimerization scaffold for the production of recombinant bispecific and trispecific antibody derivatives" The Journal of Immunology 165(12):7050-7057.

Shah et al., 2020 "Bispecific anti-CD20, anti-CD19 CAR T cells for relapsed B cell malignancies: a phase 1 dose escalation and expansion trial" Nature Medicine 26:1569-1575.

Sharpe 2017, "Introduction to checkpoint inhibitors and cancer immunotherapy" Immunol Rev. 276(1):5-8.

Singer et al., 1998, Genes and Genomes, Moscow "Mir" 1:63-64.

Skolnick et al., 2000, "From genes to protein structure and function: novel applications of computational approaches in the genomic era," Trends Biotechnol, 18(1):34-9.

Skrlec et al.,2015, "Non-immunoglobulin scaffolds: a focus on their targets" Trends in Biotechnology 33(7):408-18.

Song, et al., 2003 "A New Model of Trispecific Antibody resulting the cytotxicity directed against tumor cells" ABBS, Jun. 1, 2003, 35(6):503-510.

Stephenson et al., 2020 "Characterization of a Bispecific BAFF-R X CD3 antibody for the treatment of Lymphoma" Developing Insights.

Sun et al., 1999, "Functional glycan-free adhesion domain of human cell surface recetpor CD58: design, production and NMR studies," The EMBO Journal 18:2941-2949.

Tai et al., 2007, "Targeting MEK induces myeloma-cell cytotoxicity and ihibits osteoclastogenesis" Blood 110 (5):1656-1663.

Tai et al., 2008, "Anti-CS1 humanized monoclonal antibody HuLuc63 inhibits myeloma cell adhesion and induces antibody-dependent cellular cytotoxicity in the bone marrow milieu" Blood 112(4):1329-1337.

Tran-to Su et al., 2017 "The role of Antibody Vk Framework 3 region towards Antigen binding: Effects on recombinant production and Protein L Binding" Science Reports 7:3766.

Tutt et al., "Trispecific F(AB')3 Derivatives that use cooperative signaling via the TCR/CD3 complex and CD2 to activate and redirect resting cytotoxic T cells" The Journal of Immunology, Jul. 1, 1991, vol. 147, No. 1, pp. 60-69.

Vajdos et al., 2002, "Comprehensive Functional Maps of the Antigen-binding Site of an Anti-ErbB2 Antibody Obtained with Shotgun Scanning Mutagenesis," J Mol Biol. 320(2):415-28.

Vasquez-Lombardi et al., 2015, "Challenges and opportunities for non-antibody scaffold drugs," Drug Discovery Today 20(10):1271-1283.

Versabody™ 2003, Genencor International, Inc., Palo Alto, CA, USA.

Wallner et al., 1987, ""98. Primary structure of lymphocyte function-associated antigen 3 (LFA-3). The ligand of the T lymphocyte CD2 glycoprotein,"" J. Exp. Med 166(4):923-932.

Wayne et al., 2010, ""Anti-CD22 Immunotoxin RFB4(dsFv)-PE38 (BL22) for CD22 Positive Hematologic Malignancies of Childhood: Pre-clinical Studies and Phase I Clinical Trial"" Clin Cancer Res, 16(6): 1894-1903.

Wild et al., 1999 "Tumor therapy with bispecific antibody: the targeting and triggering steps can be separated employing a CD2-based strategy" J Immunol 163(4):2064-72.

Wong et al., 2000, Rheumatoid arthritis T cells produce Th1 cytokines in response to stimulation with a novel trispecific antibody directed against CD2, CD3, and CD28, Scandinavian Journal of Rheumatology 29(5):282-287.

Wu et al., 2017 "T Cell engaging bispecific antibody (T-BsAb): From technology to therapeutics" Pharmacol Ther. 182-161-175.

Wu et al., 2019, "Building blocks for bispecific and trispecific antibodies" Methods 154:3-9.

X.B Wang, "A New Recombinant Single Chain Trispecific Antibody Recruits T Lymphocytes to Kill CEA (Carcinoma Embryonic Antigen) Positive Tumor Cells In Vitro Efficiently", Journal of Biochemistry, Apr. 1, 2004, vol. 135, No. 4, pp. 555-565.

Yacoubian, T.A., 2017 "Neurodegeneration disorders: Why Do We Need New Therapies? Drug Discovery Approaches for the Treatment of Neurodegenerative Disorders" Alzheimer's Disease, Chapter 1. Academic Press.

Zhang et al., 2020 "Preclinical Study of a Novel Tri-Specific Anti-CD3/CD19/CD20 T Cell-Engaging Antibody as a Potentially Better Treatment for NHL" Blood 136(1):22.

Zolot et al., 2013, "Antibody-drug conjugates," Nat Rev Drug Discov 12:259-260.

Cho, et al., "Anti-BCMA BiTE® AMG 701 Potently Induces Specific T Cell Lysis of Human Multiple Myeloma (MM) Cells and Immunomodulation in the Bone Marrow Microenvironment," Blood, vol. 132, Supplement 1, 2018, p. 592.

Derksen et al., 2004, "Illegitimate WNT signaling promotes proliferation of multiple myeloma cells" PNAS 101(16):6125.

Diamond et al., 1984, "Somatic mutation of the T15 heavy chain gives rise to an antibody with autoantibody specificity," Proc. Natl. Acad. Sci. 81:5841-5844.

Dirks et al., 2008, "Brain Tumor Stem Cells: Bringing Order to the Chaos of Brain Cancer" Journal of Clinical Oncology, 26:2916-2924.

(56) References Cited

OTHER PUBLICATIONS

Geis et al., 2018, "Hemibodies:Novel trivalent T-cell activating antibody derivatives for personalized Multiple Myeloma therapy," Oncology Research and Treatment 41(4):161.

Kuhn et al., 2016 "Therapeutic anti-CD3 monoclonal antibodies: from bench to bedside" Immunotherapy 8(8):889-906.

Lopez-Lazaro 2015 "The migration ability of stem cells can explain the existence of cancer unknown primary site. Rethinking metastasis" Oncoscience 2(5):467-475.

Lv et al., 2006 "Progresses in the engineered CD3 antibodies and the immunologic tolerance induced by the anti-CD3 mAbs" Immunological Journal 22(3):S21-S25.

Mabey 2014 "Epidemiology of sexually transmitted infections: worldwide" Epidemiology and Sexual Behavior, 1-4.

Ohno et al., 1985, "Antigen binding specificities of antibodies are primarily determined by seven residues of VH," Proc. Natl. Acad. Sci. 82.

Scharff, 1984, "Somatic mutation of the T15 heavy chain gives rise to an antibody with autoantibody specificity," Proc. Natl. Acad. Sci. 81, abstract.

Tran et al., 2010, "Survival comparsion between glioblastoma multiforme and other incurable cancers" Journal of Clinical Neuroscience, 17:417-421.

Bellucci et al., "complete response to donor lymphocyte infusion in patients with multiple myeloma is associated with antibody response to BCMA, a plasma cell membrane receptor", Blood, 102(11):192a-193a (2003).

Yarilin, A. A., 1999, "Basics of Immunology," M. Medicine 172-174 (with English translation) 9 pages.

Solopova et al., 2019, "Bispecific Antibodies in Clinical Practice and Clinical Trials (Literature Review)," Clinical Oncohematology 12(2): 125-144.

Singer et al., 1998, "Genes & Genomes" 33-37.

Unofficial English translation of Office Action issued Apr. 19, 2024 in connection with RU application No. 2021133487.

Unofficial English translation of Office Action issued Aug. 8, 2023 in connection with RU application No. 2020143237.

Unofficial English translation of Office Action and Search Report issued Dec. 8, 2023 in connection with RU application No. 2021137495/10.

* cited by examiner

Fab     scFab     Fc

Fv     scFv     Non-Ig
based ABM

E:T=5:1

E:T=3:1

E:T=1:1

E:T=1:3

————◯———— AB3_TCR-CD58 Trispecific

··········☐·········· AB3_CD58 TCR Trispecific

---▲--- AB3_TCR Bispecific

————▽———— AB3_TCR-OAA Bispecific

---◆--- AB3_TCR-HEL Trispecific

Dose (pM)

| 1 | 29 | | 123 | | 216 | 239 | 250 |
|---|---|---|---|---|---|---|---|
| | | domain 1 | | domain 2 | | | |
| SP | Ig-V like dom. | | | Ig-C like dom. | | TM | C |

TRISPECIFIC BINDING MOLECULES AGAINST BCMA AND USES THEREOF

1. CROSS-REFERENCE TO RELATED APPLICATIONS

This application claims the priority benefit of U.S. provisional application Nos. 62/850,889, filed May 21, 2019, and 62/854,667, filed May 30, 2019, the contents of both of which are incorporated herein in their entireties by reference thereto.

2. SEQUENCE LISTING

The instant application contains a Sequence Listing which has been submitted electronically in ASCII format and is hereby incorporated by reference in its entirety. Said ASCII copy, created on May 13, 2020, is named NOV-005WO-_SL.txt and is 595,602 bytes in size.

3. FIELD OF INVENTION

The disclosure generally relates to multispecific binding molecules that engage BCMA, CD3 or other component of a TCR complex on T-cells, and either CD2 or a human tumor-associated antigen ("TAA"), and their use for treating diseases and disorders associated with expression of BCMA.

4. BACKGROUND

BCMA is a tumor necrosis family receptor (TNFR) member expressed on cells of the B-cell lineage. BCMA expression is the highest on terminally differentiated B cells that assume the long lived plasma cell fate, including plasma cells, plasmablasts and a subpopulation of activated B cells and memory B cells. BCMA is involved in mediating the survival of plasma cells for maintaining long-term humoral immunity. The expression of BCMA has been linked to a number of cancers, autoimmune disorders, and infectious diseases. Cancers with increased expression of BCMA include some hematological cancers, such as multiple myeloma, Hodgkin's and non-Hodgkin's lymphoma, various leukemias, and glioblastoma.

Redirected targeted T-cell lysis (RTCC) is an exciting mechanism for first line treatment and refractory settings. Antibodies and antibody fragments with their exquisite selectivity have been successfully engineered in a variety of formats to allow for the dual specificities required to cross-link T-cells to a single receptor on the target cell.

There is a need for improved RTCC approaches that target BCMA.

5. SUMMARY

The present disclosure extends the principles of redirected targeted T-cell lysis (RTCC) by providing multispecific binding molecules ("MBMs") that engage BCMA, CD3 or other component of a T cell receptor (TCR) complex on T-cells, and either CD2 or a human tumor-associated antigen ("TAA"). Without being bound by theory, the inventors believe that combining CD2- and TCR complex-engagement in a single multispecific molecule can stimulate both a primary signaling pathway that promotes T-cell mediated lysis of tumor cells (by clustering TCRs, for example) and a second co-stimulatory pathway to induce T-cell proliferation and potentially overcome anergy. Also without being bound by theory, it is believed that engaging a TAA in addition to BCMA and a component of a TCR complex will improve the clinical outcomes of RTCC therapy of cancer, e.g., B cell malignancies by targeting a greater number of cancerous B cells than using bispecific engagers that target only a BCMA and a TCR complex component.

In one aspect, the present disclosure provides MBMs (e.g., trispecific binding molecules ("TBMs")) that bind to (1) human BCMA, (2) CD3 or other component of a TCR complex, and (3) CD2.

In another aspect, the present disclosure provides MBMs (e.g., trispecific binding molecules ("TBMs")) that bind to (1) human BCMA, (2) CD3 or other component of a TCR complex, and (3) a TAA.

The MBMs (e.g., TBMs) comprise at least three antigen-binding modules ("ABMs") that can bind (i) BCMA (ABM1), (ii) a component of a TCR complex (ABM2), and (iii) either CD2 or a TAA (ABM3). In some embodiments, each antigen-binding module is capable of binding its respective target at the same time as each of the other antigen-binding modules is bound to its respective target. ABM1 is immunoglobulin based, while ABM2 and ABM3 can be immunoglobulin- or non-immunoglobulin-based. Therefore the MBMs (e.g., TBMs) can include immunoglobulin-based ABMs or any combination of immunoglobulin- and non-immunoglobulin-based ABMs. Immunoglobulin-based ABMs that can be used in the MBMs (e.g., TBMs) are described in Section 7.2.1 and specific embodiments 1 to 142, 145 to 741, 782 to 793, 798 to 803, and 833 to 856, infra. Non-immunoglobulin-based ABMs that can be used in the MBMs (e.g., TBMs) are described in Section 7.2.2 and specific embodiments 143 to 144, 743 to 782, and 795 to 797, infra. Further features of exemplary ABMs that bind to human BCMA are described in Section 7.5 and specific embodiments 1 to 142, infra. Further features of exemplary ABMs that bind to a component of a TCR complex are described in Section 7.6 and specific embodiments 151 to 741, infra. Further features of exemplary ABMs that bind to CD2 are described in Section 7.7 and specific embodiments 742 to 793, infra. Further features of exemplary ABMs that bind to TAAs are described in Section 7.8 and specific embodiments 794 to 856, infra.

The ABMs of a MBM (e.g., TBM) (or portions thereof) can be connected to each other, for example, by short peptide linkers or by an Fc domain. Methods and components for connecting ABMs to form a MBM are described in Section 7.3 and specific embodiments 857 to 1159, infra.

MBMs (e.g., TBMs) have at least three ABMs (e.g., a TBM is at least trivalent), but can also have more than three ABMs. For example, a MBM (e.g., a TBM) can have four ABMs (i.e., is tetravalent), five ABMs (i.e., is pentavalent), or six ABMs (i.e., is hexavalent), provided that the MBM has at least one ABM that can bind BCMA, at least one ABM that can bind a component of a TCR complex, and at least one ABM that can bind either CD2 or a TAA. Exemplary trivalent, tetravalent, pentavalent, and hexavalent TBM configurations are shown in FIG. 1 and described in Section 7.4 and specific embodiments 1160 to 1263, infra.

The disclosure further provides nucleic acids encoding the MBMs (either in a single nucleic acid or a plurality of nucleic acids) and recombinant host cells and cell lines engineered to express the nucleic acids and MBMs of the disclosure. Exemplary nucleic acids, host cells, and cell lines are described in Section 7.9 and specific embodiments 1653 to 1660, infra.

The present disclosure further provides drug conjugates comprising the MBMs of the disclosure. Such conjugates are referred to herein as "antibody-drug conjugates" or "ADCs" for convenience, notwithstanding that some of the ABMs can be non-immunoglobulin domains. Examples of ADCs are described in Section 7.10 and specific embodiments 1396 to 1435, infra.

Pharmaceutical compositions comprising the MBMs and ADCs are also provided. Examples of pharmaceutical compositions are described in Section 7.11 and specific embodiment 1494, infra.

Further provided herein are methods of using the MBMs, the ADCs, and the pharmaceutical compositions of the disclosure, for example for treating proliferative conditions (e.g., cancers), on which BCMA is expressed, for treating autoimmune disorders, and for treating other diseases and conditions associated with expression of BCMA. Exemplary methods are described in Section 7.12 and specific embodiments 1495 to 1575, infra.

The disclosure further provides methods of using the MBMs, the ADCs, and the pharmaceutical compositions in combination with other agents and therapies. Exemplary agents, therapies, and methods of combination therapy are described in Section 7.13 and specific embodiments 1576 to 1652, infra.

6. BRIEF DESCRIPTION OF THE FIGURES

Figure 1B:
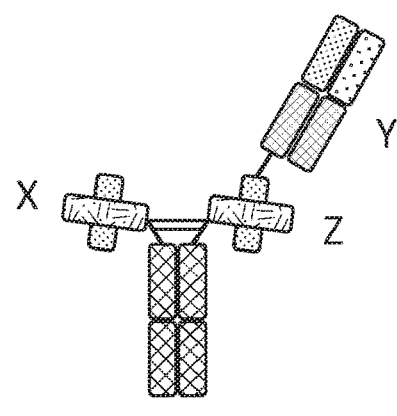
Figure 1C:
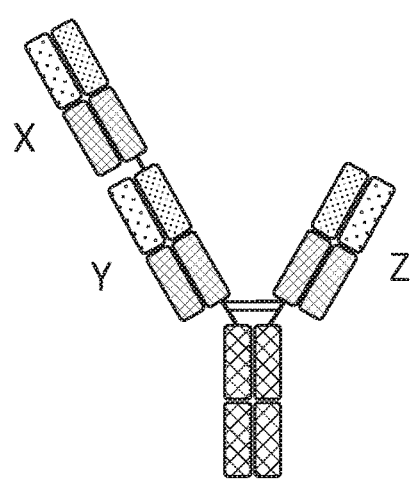
Figure 1D:
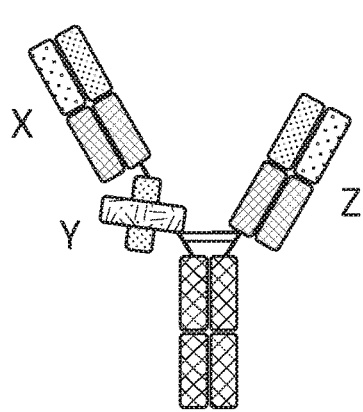
Figure 1E:
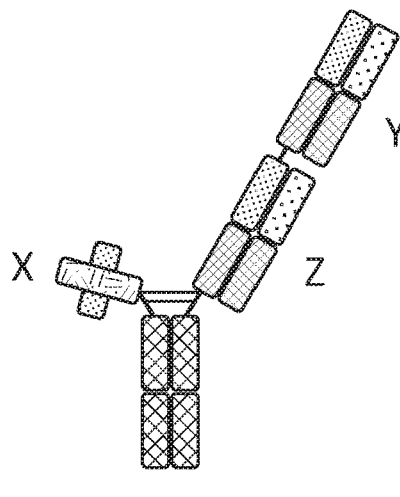
Figure 1F:
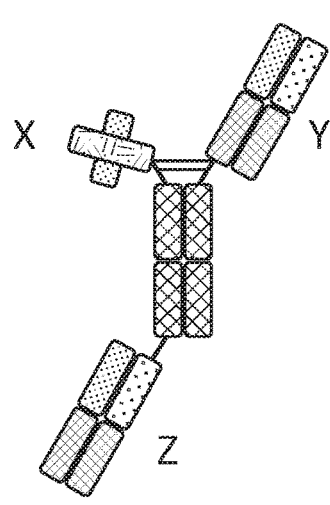
Figure 1G:
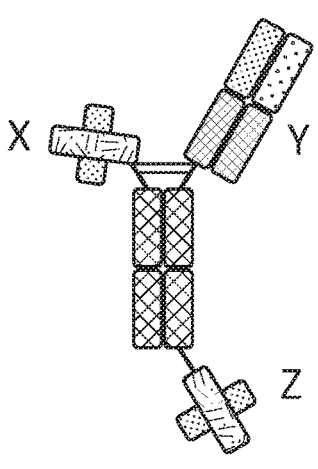
Figure 1H:
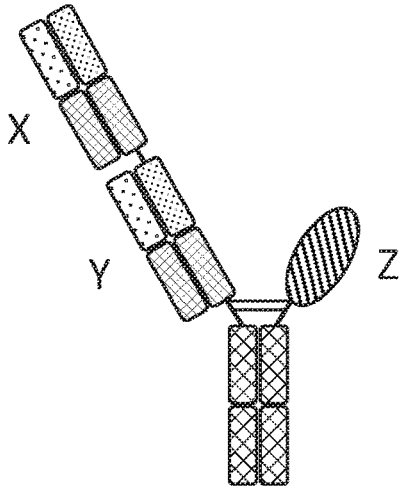
Figure 1I:
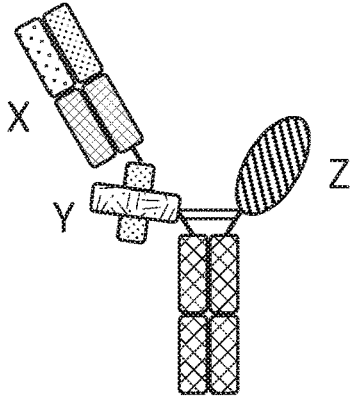
Figure 1J:
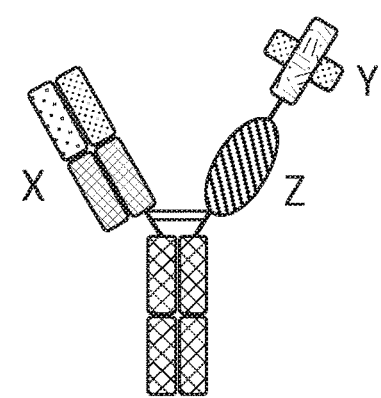
Figure 1K:
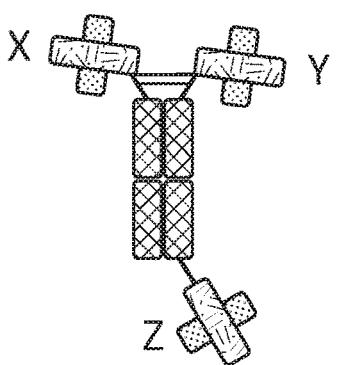
Figure 1L:
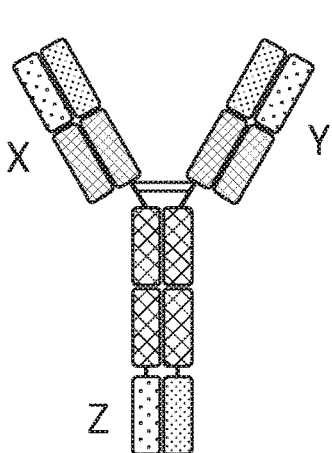
Figure 1M:
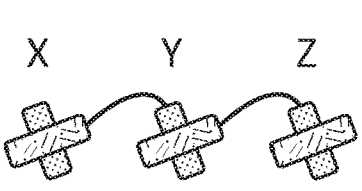
Figure 1N:
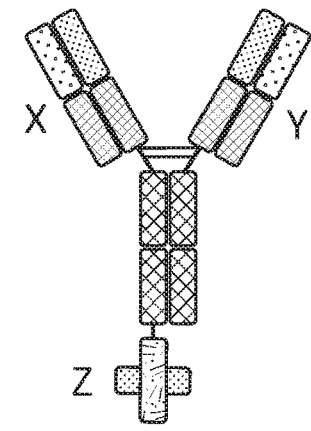
Figure 1O:
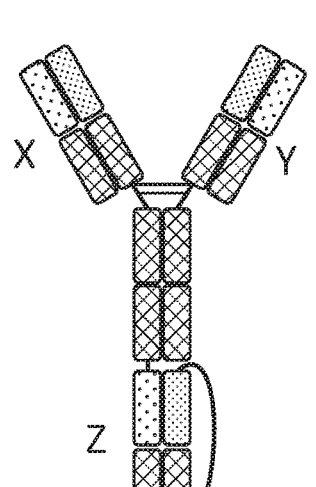
Figure 1P:
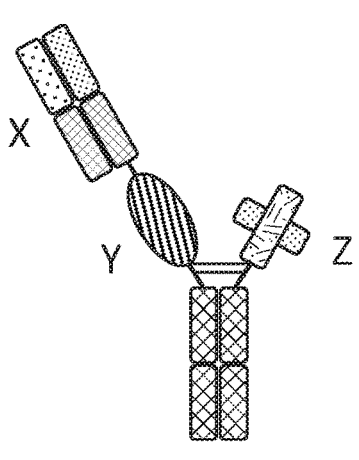
Figure 1Q:
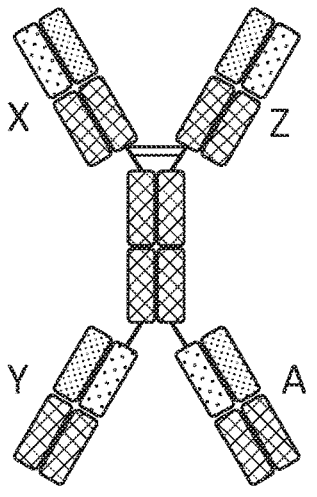
Figure 1R:
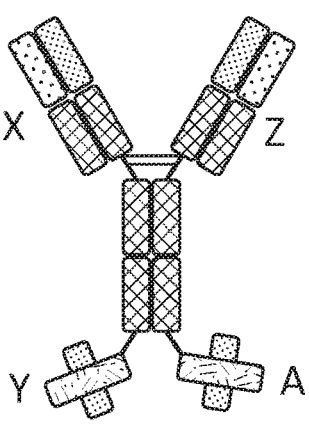
Figure 1S:
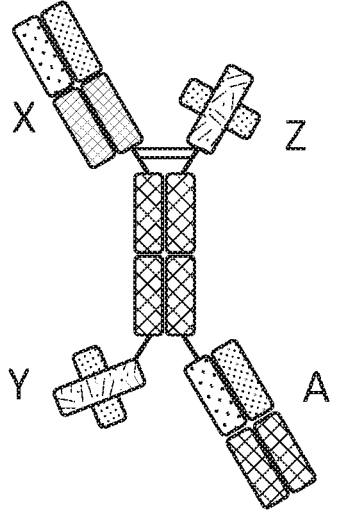
Figure 1T:
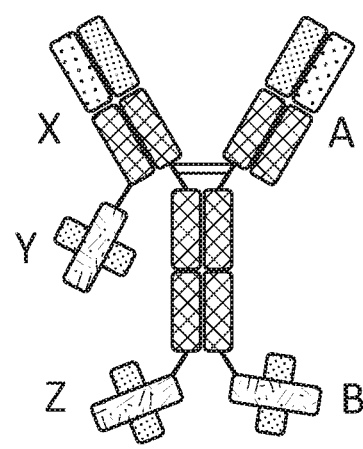
Figure 1U:
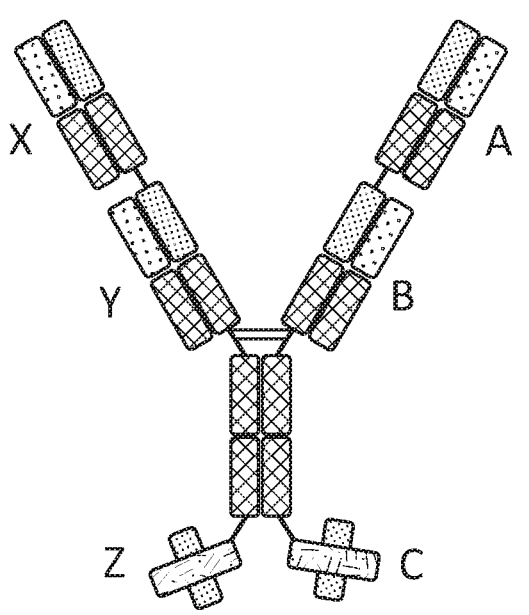
Figure 1V:
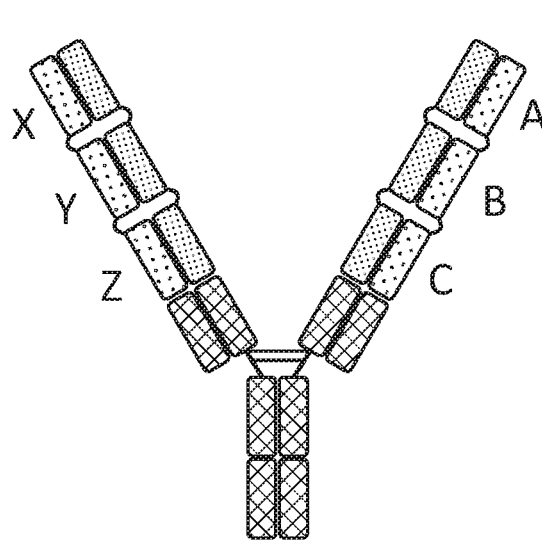

FIGS. 1A-1V: Exemplary TBM configurations. FIG. 1A illustrates components of the exemplary TBM configurations illustrated in FIGS. 1B-1V. Not all regions connecting the different domains of each chain are illustrated (e.g., the linker connecting the VH and VL domains of an scFv, the hinge connecting the CH2 and CH3 domains of an Fc, etc., are omitted). FIG. 1B-1P illustrates trivalent TBMs; FIGS. 1Q-1S illustrate tetravalent TBMs; FIG. 1T illustrates a pentavalent TBM, and FIGS. 1U-1V illustrate hexavalent TBMs.

Figure 2A:
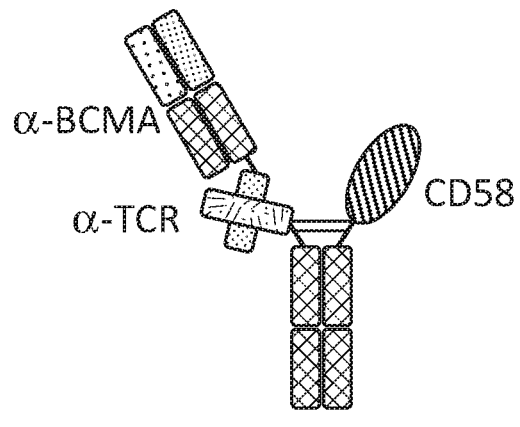
Figure 2B:
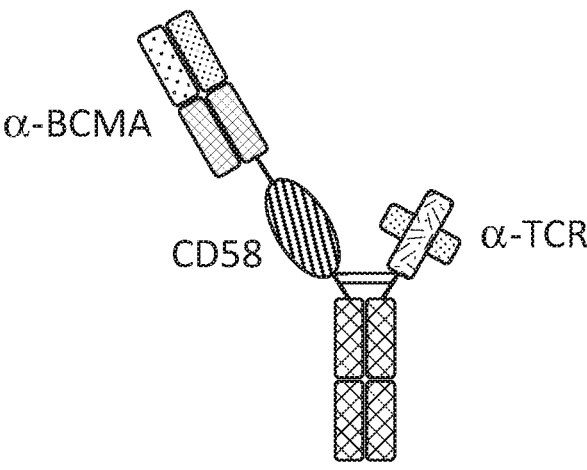

FIGS. 2A-2B: Schematics of the trispecific constructs of Example 2.

Figure 3A:
Figure 3A:
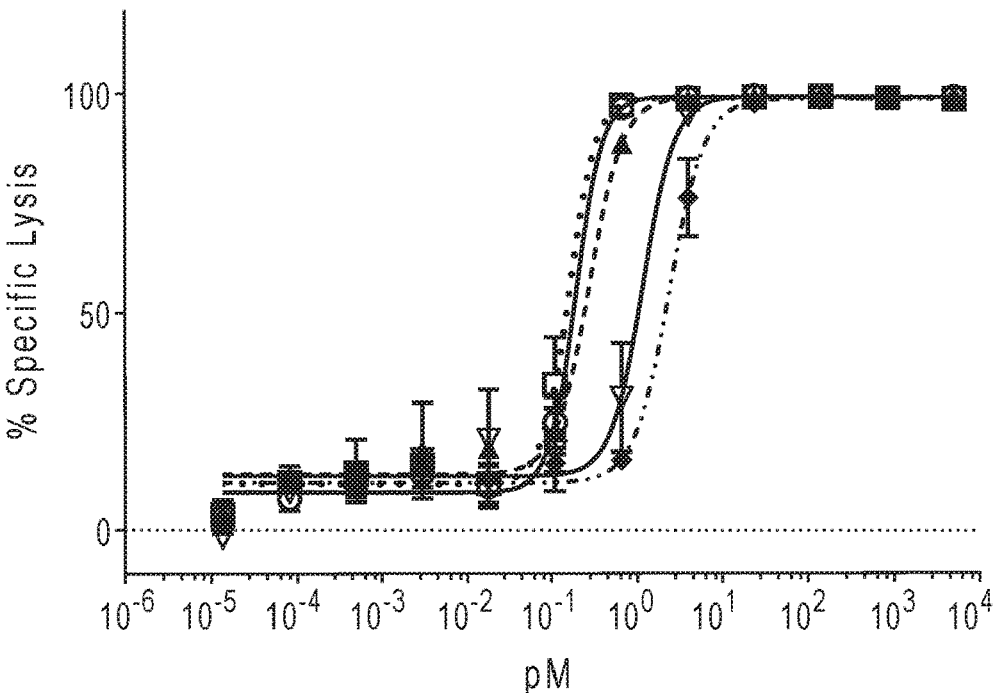
Figure 3B:
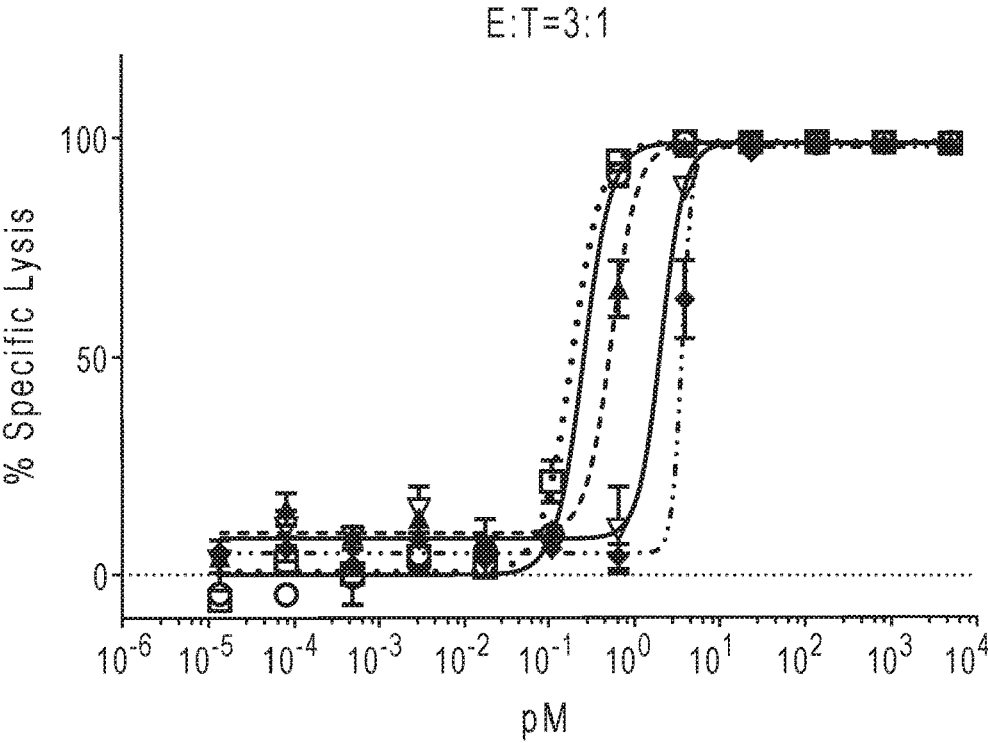
Figure 3C:
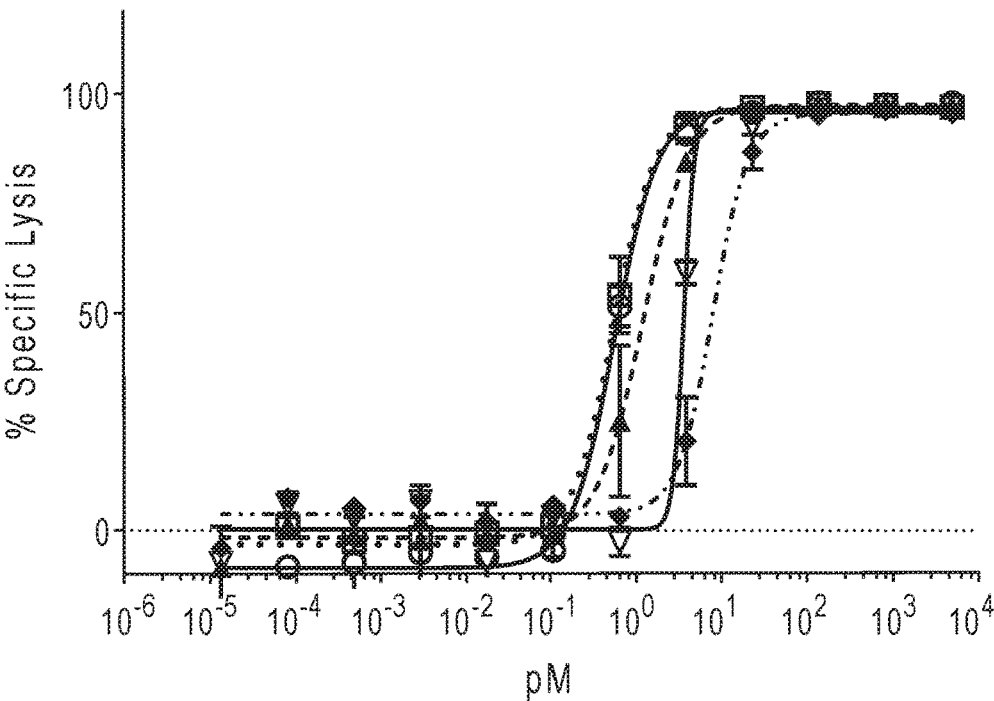
Figure 3D:
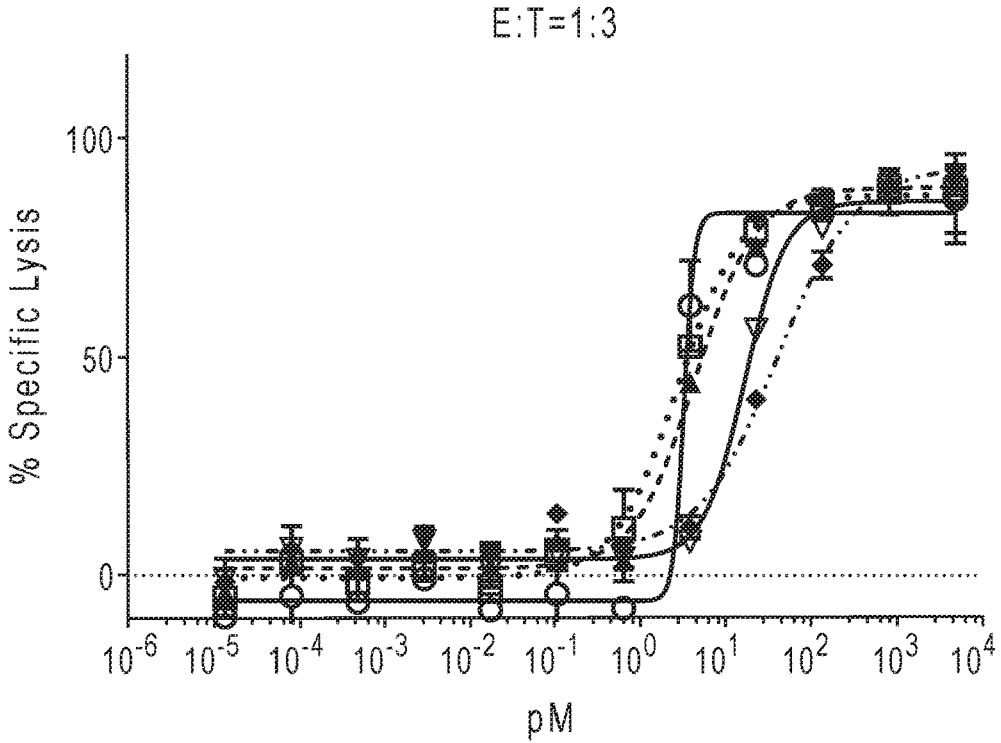
Figures 3E, 3F:
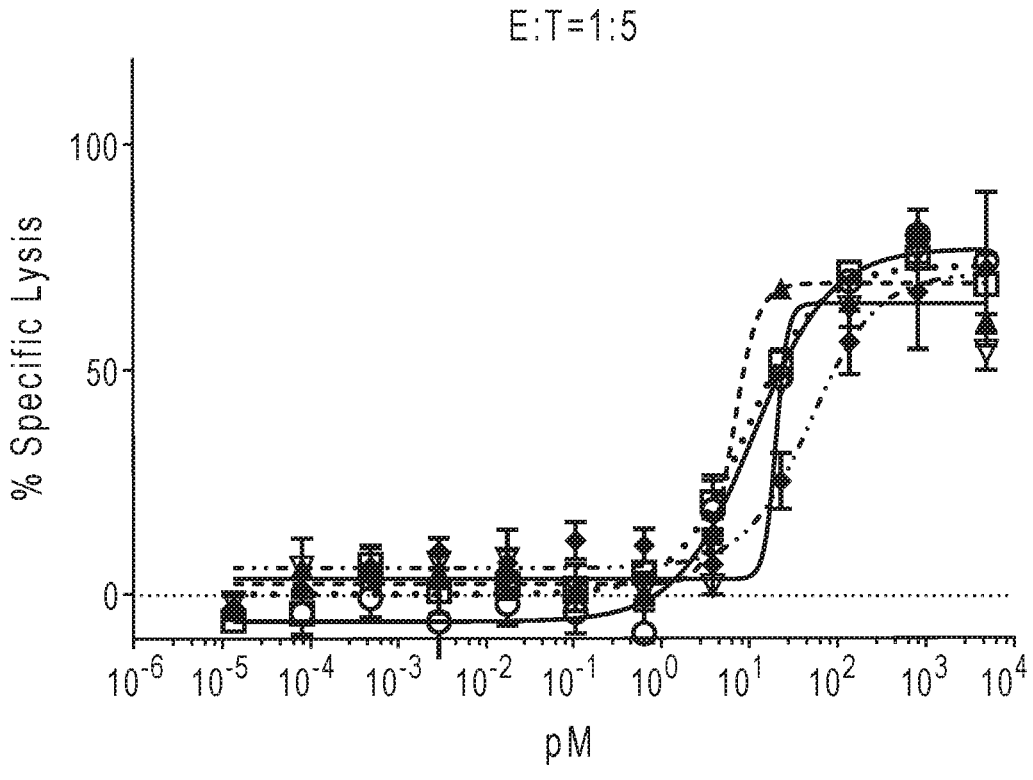

FIGS. 3A-3F: Results of RTCC assay of Example 2. FIG. 3A: E:T ratio of 5:1; FIG. 3B: E:T ratio of 3:1; FIG. 3C: ET ratio of 1:1; FIG. 3D: E:T ratio of 1:3; FIG. 3E: E:T ratio of 1:5; FIG. 3F: figure legend.

Figure 4A:
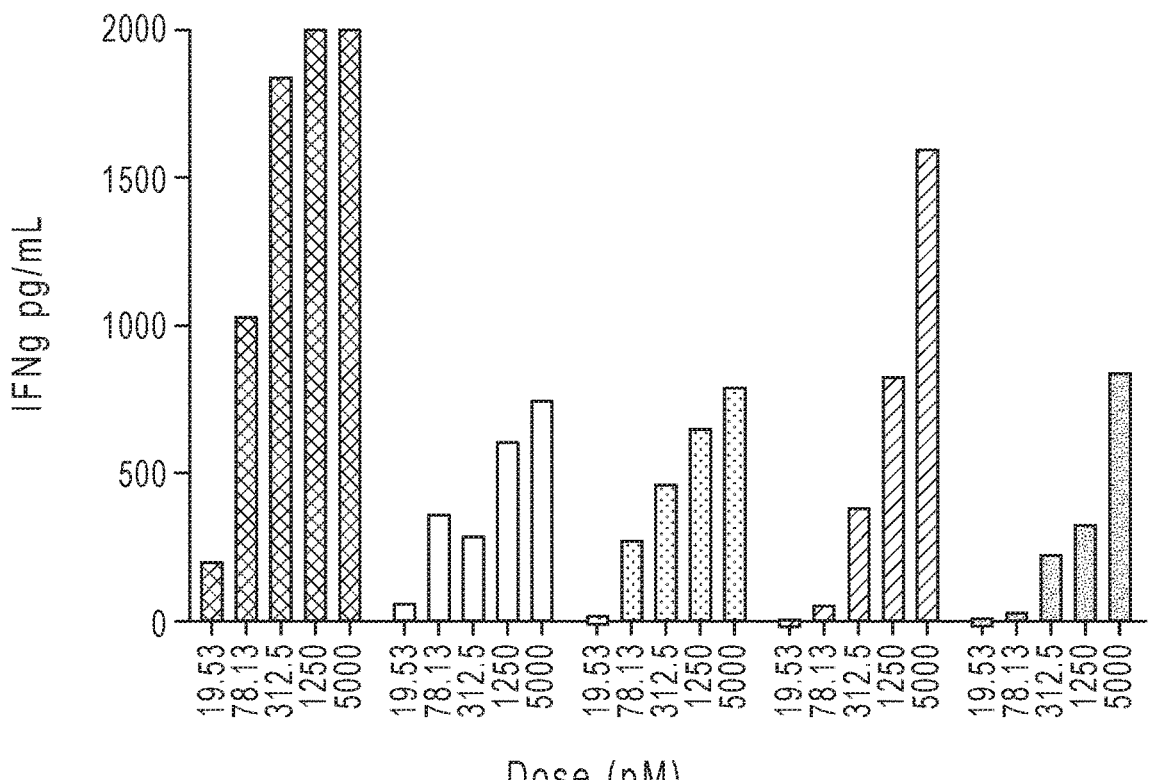
Figure 4B:
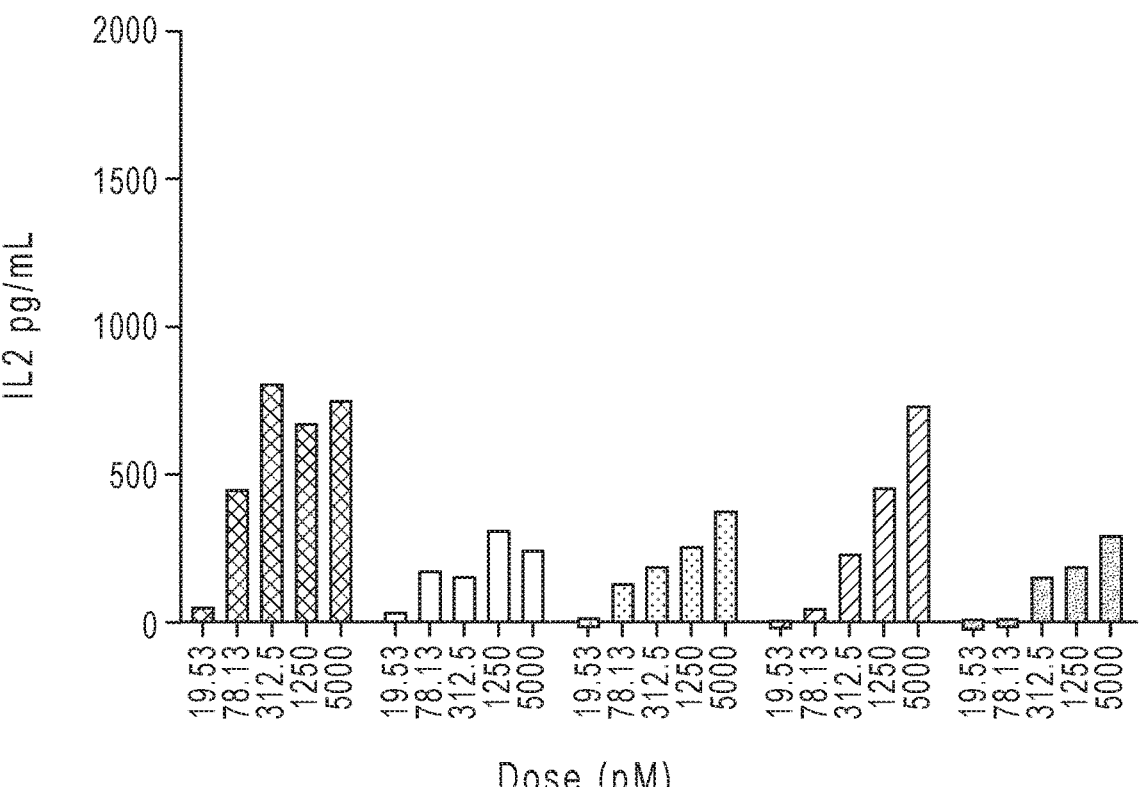
Figures 4C, 5:
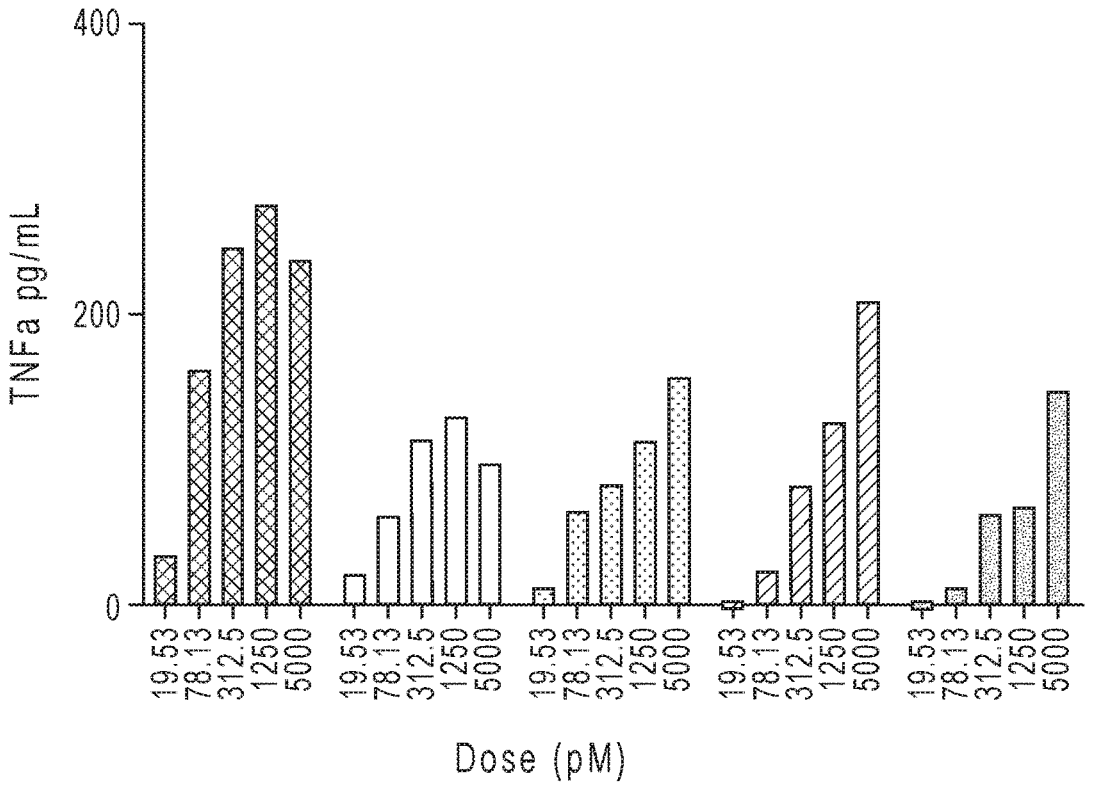

FIGS. 4A-C: Measurements for cytokines IFN-γ (FIG. 4A), IL-2 (FIG. 4B), and TNF-α (FIG. 4C) from cytokine release assay of Example 2 at E:T ratio of 1:5. From left to right in each figure, data is shown for AB3_TCR-CD58 trispecific, AB3_CD58 TCR trispecific, BSP, OAA, AB3_TCR-HEL bispecific.

FIG. 5: A schematic representation of CD58.

7. DETAILED DESCRIPTION

7.1. Definitions

As used herein, the following terms are intended to have the following meanings:

ABM chain: Individual ABMs can exist as one (e.g., in the case of an scFv) polypeptide chain or form through the association of more than one polypeptide chains (e.g., in the case of a Fab). As used herein, the term "ABM chain" refers to all or a portion of an ABM that exists on a single polypeptide chain. The use of the term "ABM chain" is intended for convenience and descriptive purposes only and does not connote a particular configuration or method of production.

ADCC: By "ADCC" or "antibody dependent cell-mediated cytotoxicity" as used herein is meant the cell-mediated reaction where nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

ADCP: By "ADCP" or antibody dependent cell-mediated phagocytosis as used herein is meant the cell-mediated reaction where nonspecific phagocytic cells that express FcγRs recognize bound antibody on a target cell and subsequently cause phagocytosis of the target cell.

Additional Agent: For convenience, an agent that is used in combination with a MBM is referred to herein as an "additional" agent.

Antibody: The term "antibody" as used herein refers to a polypeptide (or set of polypeptides) of the immunoglobulin family that is capable of binding an antigen non-covalently, reversibly and specifically. For example, a naturally occurring "antibody" of the IgG type is a tetramer comprising at least two heavy (H) chains and two light (L) chains interconnected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain (abbreviated herein as CL). The VH and VL regions can be further subdivided into regions of hypervariability, termed complementarity determining regions (CDR), interspersed with regions that are more conserved, termed framework regions (FR). Each VH and VL is composed of three CDRs and four FRs arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (CIq) of the classical complement system. The term "antibody" includes, but is not limited to, monoclonal antibodies, human antibodies, humanized antibodies, camelised antibodies, chimeric antibodies, bispecific or multispecific antibodies and anti-idiotypic (anti-Id) antibodies (including, e.g., anti-Id antibodies to antibodies of the disclosure). The antibodies can be of any isotype/class (e.g., IgG, IgE, IgM, IgD, IgA and IgY) or subclass (e.g., IgG1, IgG2, IgG3, IgG4, IgA1 and IgA2).

Both the light and heavy chains are divided into regions of structural and functional homology. The terms "constant" and "variable" are used functionally. In this regard, it will be appreciated that the variable domains of both the light (VL) and heavy (VH) chain portions determine antigen recognition and specificity. Conversely, the constant domains of the light chain (CL) and the heavy chain (CH1, CH2 or CH3) confer important biological properties such as secretion, transplacental mobility, Fc receptor binding, complement binding, and the like. By convention the numbering of the constant region domains increases as they become more distal from the antigen-binding site or amino-terminus of the antibody. The N-terminus is a variable region and at the C-terminus is a constant region; the CH3 and CL domains actually comprise the carboxy-terminus of the heavy and light chain, respectively.

Antibody fragment: The term "antibody fragment" of an antibody as used herein refers to one or more portions of an antibody. In some embodiments, these portions are part of the contact domain(s) of an antibody. In some other embodiments, these portion(s) are antigen-binding fragments that retain the ability of binding an antigen non-covalently, reversibly and specifically, sometimes referred to herein as the "antigen-binding fragment", "antigen-binding fragment thereof," "antigen-binding portion", and the like. Examples of binding fragments include, but are not limited to, single-chain Fvs (scFv), a Fab fragment, a monovalent fragment consisting of the VL, VH, CL and CH1 domains; a F(ab)2 fragment, a bivalent fragment comprising two Fab fragments linked by a disulfide bridge at the hinge region; a Fd fragment consisting of the VH and CH1 domains; a Fv fragment consisting of the VL and VH domains of a single arm of an antibody; a dAb fragment (Ward et al., (1989) Nature 341:544-546), which consists of a VH domain; and an isolated complementarity determining region (CDR). Thus, the term "antibody fragment" encompasses both proteolytic fragments of antibodies (e.g., Fab and F(ab)2 fragments) and engineered proteins comprising one or more portions of an antibody (e.g., an scFv).

Antibody fragments can also be incorporated into single domain antibodies, maxibodies, minibodies, intrabodies, diabodies, triabodies, tetrabodies, v-NAR and bis-scFv (see, e.g., Hollinger and Hudson, 2005, Nature Biotechnology 23: 1126-1136). Antibody fragments can be grafted into scaffolds based on polypeptides such as Fibronectin type III (Fn3) (see U.S. Pat. No. 6,703,199, which describes fibronectin polypeptide monobodies).

Antibody fragments can be incorporated into single chain molecules comprising a pair of tandem Fv segments (for example, VH-CH1-VH-CH1) which, together with complementary light chain polypeptides (for example, VL-VC-VL-VC), form a pair of antigen-binding regions (Zapata et al., 1995, Protein Eng. 8:1057-1062; and U.S. Pat. No. 5,641, 870).

Antibody Numbering System: In the present specification, the references to numbered amino acid residues in antibody domains are based on the EU numbering system unless otherwise specified (for example, in Tables 11C-1-11C-2). This system was originally devised by Edelman et al., 1969, Proc. Nat'l Acad. Sci. USA 63:78-85 and is described in detail in Kabat et al., 1991, in Sequences of Proteins of Immunological Interest, US Department of Health and Human Services, NIH, USA.

Antigen-binding module: The term "antigen-binding module" or "ABM" as used herein refers to a portion of a MBM that has the ability to bind to an antigen non-covalently, reversibly and specifically. An ABM can be immunoglobulin- or non-immunoglobulin-based. As used herein, the terms "ABM1" and "BCMA ABM" (and the like) refer to an ABM that binds specifically to BCMA, the terms "ABM2" and "TCR ABM" (and the like) refer to an ABM that binds specifically to a component of a TCR complex, the term "ABM3" refers to an ABM that binds specifically to CD2 or to a TAA (depending on context), the term "CD2 ABM" (and the like) refers to an ABM that binds specifically to CD2, and the term "TAA ABM" (and the like) refers to an ABM that binds specifically to a TAA. The terms ABM1, ABM2, and ABM3 are used merely for convenience and are not intended to convey any particular configuration of a MBM. In some embodiments, an ABM2 binds to CD3 (referred to herein a "CD3 ABM" or the like). Accordingly, disclosures relating to ABM2 and ABM2s are also applicable to CD3 ABMs.

Antigen-binding domain: The term "antigen-binding domain" (ABD) refers to a portion of a molecule that has the ability to bind to an antigen non-covalently, reversibly and specifically. Exemplary antigen-binding domains include antigen-binding fragments and portions of both immunoglobulin and non-immunoglobulin based scaffolds that retain the ability of binding an antigen non-covalently, reversibly and specifically. As used herein, the term "antigen-binding domain" encompasses antibody fragments that retain the ability of binding an antigen non-covalently, reversibly and specifically.

Antigen-binding fragment: The term "antigen-binding fragment" of an antibody refers to a portion of an antibody that retains has the ability to bind to an antigen non-covalently, reversibly and specifically.

Associated: The term "associated" in the context of a MBM refers to a functional relationship between two or more polypeptide chains. In particular, the term "associated" means that two or more polypeptides are associated with one another, e.g., non-covalently through molecular interactions or covalently through one or more disulfide bridges or chemical cross-linkages, so as to produce a functional MBM (e.g., a TBM) in which ABM1, ABM2 and ABM3 can bind their respective targets. Examples of associations that might be present in a MBM include (but are not limited to) associations between Fc regions in an Fc domain (homodimeric or heterodimeric as described in Section 7.3.1.5), associations between VH and VL regions in a Fab or Fv, and associations between CH1 and CL in a Fab.

B cell: As used herein, the term "B cell" refers to a cell of B cell lineage, which is a type of white blood cell of the lymphocyte subtype. Examples of B cells include plasmablasts, plasma cells, lymphoplasmacytoid cells, memory B cells, follicular B cells, marginal zone B cells, B-1 cells, B-2 cells, and regulatory B cells.

B cell malignancy: As used herein, a B cell malignancy refers to an uncontrolled proliferation of B cells. Examples of B cell malignancy include non-Hodgkin's lymphomas (NHL), Hodgkin's lymphomas, leukemia, and myeloma. For example, a B cell malignancy can be, but is not limited to, multiple myeloma, chronic lymphocytic leukemia (CLL)/small lymphocytic lymphoma (SLL), follicular lymphoma, mantle cell lymphoma (MCL), diffuse large B-cell lymphoma (DLBCL), marginal zone lymphomas, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, and primary effusion lymphoma, and plasmacytic dendritic cell neoplasms.

BCMA: As used herein, the term "BCMA" refers to B-cell maturation antigen. BCMA (also known as TNFRSF17, BCM or CD269) is a member of the tumor necrosis receptor (TNFR) family and is predominantly expressed on terminally differentiated B cells, e.g., memory B cells and plasma cells. Its ligands include B-cell activating factor (BAFF) and a proliferation-inducing ligand (APRIL). The protein BCMA is encoded by the gene TNFRSF17. Exemplary BCMA sequences are available at the Uniprot database under accession number Q02223.

Binding Sequences: In reference to Tables 11, 12, 13, 14, or 17 (including subparts thereof), the term "binding sequences" means an ABM having a full set of CDRs, a VH-VL pair, or an scFv set forth in that table.

Bivalent: The term "bivalent" as used herein in the context of an antigen-binding molecule refers to an antigen-binding molecule that has two antigen-binding domains. The domains can be the same or different. Accordingly, a bivalent antigen-binding molecule can be monospecific or bispecific.

Cancer: The term "cancer" refers to a disease characterized by the uncontrolled (and often rapid) growth of aberrant cells. Cancer cells can spread locally or through the bloodstream and lymphatic system to other parts of the body. Examples of various cancers are described herein and include but are not limited to, leukemia, multiple myeloma, asymptomatic myeloma, Hodgkin's lymphoma and non-Hodgkin's lymphoma, e.g., any BCMA-positive cancers of any of the foregoing types. The term "cancerous B cell" refers to a B cell that is undergoing or has undergone uncontrolled proliferation CD3: The term "CD3" or "cluster of differentiation 3" refers to the cluster of differentiation 3 co-receptor of the T cell receptor. CD3 helps in activation of both cytotoxic T-cell (e.g., CD8+ naïve T cells) and T helper cells (e.g., CD4+ naïve T cells) and is composed of four distinct chains: one CD3γ chain (e.g., Genbank Accession Numbers NM_000073 and MP_000064 (human)), one CD3δ chain (e.g., Genbank Accession Numbers NM_000732, NM_001040651, NP_00732 and NP_001035741 (human)), and two CD3ε chains (e.g., Genbank Accession Numbers NM_000733 and NP_00724 (human)). The chains of CD3 are highly related cell-surface proteins of the immunoglobulin superfamily containing a single extracellular immunoglobulin domain. The CD3 molecule associates with the T-cell receptor (TCR) and chain to form the T-cell receptor (TCR) complex, which functions in generating activation signals in T lymphocytes.

Unless expressly indicated otherwise, the reference to CD3 in the application can refer to the CD3 co-receptor, the CD3 co-receptor complex, or any polypeptide chain of the CD3 co-receptor complex.

Chimeric Antibody: The term "chimeric antibody" (or antigen-binding fragment thereof) is an antibody molecule (or antigen-binding fragment thereof) in which (a) the constant region, or a portion thereof, is altered, replaced or exchanged so that the antigen-binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity. For example, a mouse antibody can be modified by replacing its constant region with the constant region from a human immunoglobulin. Due to the replacement with a human constant region, the chimeric antibody can retain its specificity in recognizing the antigen while having reduced antigenicity in human as compared to the original mouse antibody.

In combination: Administered "in combination," as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons.

Complementarity Determining Rection: The terms "complementarity determining region" or "CDR," as used herein, refer to the sequences of amino acids within antibody variable regions which confer antigen specificity and binding affinity. For example, in general, there are three CDRs in each heavy chain variable region (e.g., CDR-H1, CDR-H2, and CDR-H3) and three CDRs in each light chain variable region (CDR-L1, CDR-L2, and CDR-L3). The precise amino acid sequence boundaries of a given CDR can be determined using any of a number of well-known schemes, including those described by Kabat et al., 1991, "Sequences of Proteins of Immunological Interest," 5th Ed. Public Health Service, National Institutes of Health, Bethesda, MD ("Kabat" numbering scheme), Al-Lazikani et al., 1997, JMB 273:927-948 ("Chothia" numbering scheme) and ImMunoGenTics (IMGT) numbering (Lefranc, 1999, The Immunologist 7:132-136 (1999); Lefranc et al., 2003, Dev. Comp. Immunol. 27:55-77 ("IMGT" numbering scheme). For example, for classic formats, under Kabat, the CDR amino acid residues in the heavy chain variable domain (VH) are numbered 31-35 (CDR-H1), 50-65 (CDR-H2), and 95-102 (CDR-H3); and the CDR amino acid residues in the light chain variable domain (VL) are numbered 24-34 (CDR-L1), 50-56 (CDR-L2), and 89-97 (CDR-L3). Under Chothia, the CDR amino acids in the VH are numbered 26-32 (CDR-H1), 52-56 (CDR-H2), and 95-102 (CDR-H3); and the amino acid residues in VL are numbered 26-32 (CDR-L1), 50-52 (CDR-L2), and 91-96 (CDR-L3). By combining the CDR definitions of both Kabat and Chothia, the CDRs consist of amino acid residues 26-35 (CDR-H1), 50-65 (CDR-H2), and 95-102 (CDR-H3) in human VH and amino acid residues 24-34 (CDR-L1), 50-56 (CDR-L2), and 89-97 (CDR-L3) in human VL. Under IMGT the CDR amino acid residues in the VH are numbered approximately 26-35 (CDR-H1), 51-57 (CDR-H2) and 93-102 (CDR-H3), and the CDR amino acid residues in the VL are numbered approximately 27-32 (CDR-L1), 50-52 (CDR-L2), and 89-97 (CDR-L3) (numbering according to "Kabat"). Under IMGT, the CDR regions of an antibody can be determined using the program IMGT/DomainGap Align.

Concurrently: The term "concurrently" is not limited to the administration of therapies (e.g., prophylactic or therapeutic agents) at exactly the same time, but rather it is meant that a pharmaceutical composition comprising MBM or ADC is administered to a subject in a sequence and within a time interval such that the molecules can act together with the additional therapy(ies) to provide an increased benefit than if they were administered otherwise.

Conservative Sequence Modifications: The term "conservative sequence modifications" refers to amino acid modifications that do not significantly affect or alter the binding characteristics of a MBM or a component thereof (e.g., an ABM or an Fc region). Such conservative modifications include amino acid substitutions, additions and deletions. Modifications can be introduced into a MBM by standard techniques, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a MBM can be replaced with other amino acid residues from the same side chain family and the altered MBM can be tested for, e.g., binding to target molecules and/or effective heterodimerization and/or effector function.

Diabody: The term "diabody" as used herein refers to small antibody fragments with two antigen-binding sites, typically formed by pairing of scFv chains. Each scFv comprises a heavy chain variable domain (VH) connected to a light chain variable domain (VL) in the same polypeptide chain (VH-VL, where the VH is either N-terminal or C-terminal to the VL). Unlike a typical scFv in which the VH and VL are separated by a linker that allows the VH and VL on the same polypeptide chain to pair and form an antigen-binding domain, diabodies typically comprise a linker that is too short to allow pairing between the VH and VL domains on the same chain, forcing the VH and VL domains to pair with the complementary domains of another chain and create two antigen-binding sites. Diabodies are described more fully in, for example, EP 404,097; WO 93/11161; and Hollinger et al., 1993, Proc. Natl. Acad. Sci. USA 90:6444-6448.

dsFv: The term "dsFv" refers to disulfide-stabilized Fv fragments. In a dsFv, a VH and VL are connected by an interdomain disulfide bond. To generate such molecules, one amino acid each in the framework region of in VH and VL are mutated to a cysteine, which in turn form a stable interchain disulfide bond. Typically, position 44 in the VH and position 100 in the VL are mutated to cysteines. See Brinkmann, 2010, Antibody Engineering 181-189, D01: 10.1007/978-3-642-01147-4_14. The term dsFv encompasses both what is known as a dsFv (a molecule in which the VH and VL are connected by an interchain disulfide bond but not a linker peptide) or scdsFv (a molecule in which the VH and VL are connected by a linker as well as an interchain disulfide bond).

Effector Function: The term "effector function" refers to an activity of an antibody molecule that is mediated by binding through a domain of the antibody other than the antigen-binding domain, usually mediated by binding of effector molecules. Effector function includes complement-mediated effector function, which is mediated by, for example, binding of the C1 component of the complement to the antibody. Activation of complement is important in the opsonization and lysis of cell pathogens. The activation of complement also stimulates the inflammatory response and may also be involved in autoimmune hypersensitivity. Effector function also includes Fc receptor (FcR)-mediated effector function, which can be triggered upon binding of the constant domain of an antibody to an Fc receptor (FcR). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production. An effector function of an antibody can be altered by altering, e.g., enhancing or reducing, the affinity of the antibody for an effector molecule such as an Fc receptor or a complement component. Binding affinity will generally be varied by modifying the effector molecule binding site, and in this case it is appropriate to locate the site of interest and modify at least part of the site in a suitable way. It is also envisaged that an alteration in the binding site on the antibody for the effector molecule need not alter significantly the overall binding affinity but may alter the geometry of the interaction rendering the effector mechanism ineffective as in non-productive binding. It is further envisaged that an effector function may also be altered by modifying a site not directly involved in effector molecule binding, but otherwise involved in performance of the effector function.

Epitope: An epitope, or antigenic determinant, is a portion of an antigen recognized by an antibody or other antigen-binding moiety as described herein. An epitope can be linear or conformational.

Fab: By "Fab" or "Fab region" as used herein is meant a polypeptide region that comprises the VH, CH1, VL, and CL immunoglobulin domain. These terms can refer to this region in isolation, or this region in the context of an antigen-binding molecule of the disclosure.

Fab domains are formed by association of a CH1 domain attached to a VH domain with a CL domain attached to a VL domain. The VH domain is paired with the VL domain to constitute the Fv region, and the CH1 domain is paired with the CL domain to further stabilize the binding module. A disulfide bond between the two constant domains can further stabilize the Fab domain.

Fab regions can be produced by proteolytic cleavage of immunoglobulin molecules (e.g., using enzymes such as papain) or through recombinant expression. In native immunoglobulin molecules, Fabs are formed by association of two different polypeptide chains (e.g., VH-CH1 on one chain associates with VL-CL on the other chain). The Fab regions are typically expressed recombinantly, typically on two polypeptide chains, although single chain Fabs are also contemplated herein.

Fc domain: The term "Fc domain" refers to a pair of associated Fc regions. The two Fc regions dimerize to create the Fc domain. The two Fc regions within the Fc domain can be the same (such an Fc domain being referred to herein as an "Fc homodimer") or different from one another (such an Fc domain being referred to herein as an "Fc heterodimer").

Fc region: The term "Fc region" or "Fc chain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc region" includes both amino acids 231-447 (CH2-CH3) or 216-447 (hinge-CH2-CH3), or fragments thereof. An "Fc fragment" in this context can contain fewer amino acids from either or both of the N- and C-termini but still retains the ability to form a dimer with another Fc region as can be detected using standard methods, generally based on size (e.g., non-denaturing chromatography, size exclusion chromatography). Human IgG Fc regions are of particular use in the present disclosure, and can be the Fc region from human IgG1, IgG2 or IgG4.

Fv: The term "Fv" refers to the minimum antibody fragment derivable from an immunoglobulin that contains a complete target recognition and binding site. This region consists of a dimer of one heavy and one light chain variable domain in a tight, noncovalent association (VH-VL dimer). It is in this configuration that the three CDRs of each variable domain interact to define a target binding site on the surface of the VH-VL dimer. Often, the six CDRs confer target binding specificity to the antibody. However, in some instances even a single variable domain (or half of an Fv comprising only three CDRs specific for a target) can have the ability to recognize and bind target. The reference to a VH-VL dimer herein is not intended to convey any particular configuration. By way of example and not limitation, the VH and VL can come together in any configuration described herein to form a half antibody, or can each be present on a separate half antibody and come together to form an antigen binding domain when the separate half antibodies associate, for example to form a TBM of the disclosure. When present on a single polypeptide chain (e.g., a scFv), the VH and be N-terminal or C-terminal to the VL.

Half Antibody: The term "half antibody" refers to a molecule that comprises at least one ABM or ABM chain and can associate with another molecule comprising an ABM or ABM chain through, e.g., a disulfide bridge or molecular interactions (e.g., knob-in-hole interactions between Fc heterodimers). A half antibody can be composed of one polypeptide chain or more than one polypeptide chains (e.g., the two polypeptide chains of a Fab). In an embodiment, a half-antibody comprises an Fc region.

An example of a half antibody is a molecule comprising a heavy and light chain of an antibody (e.g., an IgG antibody). Another example of a half antibody is a molecule comprising a first polypeptide comprising a VL domain and a CL domain, and a second polypeptide comprising a VH domain, a CH1 domain, a hinge domain, a CH2 domain, and a CH3 domain, where the VL and VH domains form an ABM. Yet another example of a half antibody is a polypeptide comprising an scFv domain, a CH2 domain and a CH3 domain.

A half antibody might include more than one ABM, for example a half-antibody comprising (in N- to C-terminal order) an scFv domain, a CH2 domain, a CH3 domain, and another scFv domain.

Half antibodies might also include an ABM chain that when associated with another ABM chain in another half antibody forms a complete ABM.

Thus, a MBM (e.g., a TBM) can comprise one, more typically two, or even more than two half antibodies, and a half antibody can comprise one or more ABMs or ABM chains.

In some MBMs, a first half antibody will associate, e.g., heterodimerize, with a second half antibody. In other MBMs, a first half antibody will be covalently linked to a second half antibody, for example through disulfide bridges or chemical crosslinking. In yet other MBMs, a first half antibody will associate with a second half antibody through both covalent attachments and non-covalent interactions, for example disulfide bridges and knob-in-hole interactions.

The term "half antibody" is intended for descriptive purposes only and does not connote a particular configuration or method of production. Descriptions of a half antibody as a "first" half antibody, a "second" half antibody, a "left" half antibody, a "right" half antibody or the like are merely for convenience and descriptive purposes.

Hexavalent: The term "hexavalent" as used herein in the context of an antigen-binding molecule (e.g., a TBM) refers to an antigen-binding molecule that has six antigen-binding domains. Hexavalent TBMs of the disclosure generally have three pairs of antigen-binding domains that each bind to the same antigen, although different configurations (e.g., three antigen-binding domains that bind to BCMA, two antigen-binding domains that bind to a component of a TCR complex, and one antigen-binding domain that binds to CD2 or a TAA, or three antigen-binding domains that bind to BCMA, two antigen-binding domains that bind to CD2 or a TAA, and one antigen-binding domain that binds to a component of a TCR complex) are within the scope of the disclosure. Examples of hexavalent TBMs are shown schematically in FIGS. 1U-1V.

Hole: In the context of a knob-into-hole, a "hole" refers to at least one amino acid side chain which is recessed from the interface of a first Fc chain and is therefore positionable in a compensatory "knob" on the adjacent interfacing sur-face of a second Fc chain so as to stabilize the Fc heterodimer, and thereby favor Fc heterodimer formation over Fc homodimer formation, for example.

Host cell or recombinant host cell: The terms "host cell" or "recombinant host cell" refer to a cell that has been genetically-engineered, e.g., through introduction of a heterologous nucleic acid. It should be understood that such terms are intended to refer not only to the particular subject cell but to the progeny of such a cell. Because certain modifications can occur in succeeding generations due to either mutation or environmental influences, such progeny may not, in fact, be identical to the parent cell, but are still included within the scope of the term "host cell" as used herein. A host cell can carry the heterologous nucleic acid transiently, e.g., on an extrachromosomal heterologous expression vector, or stably, e.g., through integration of the heterologous nucleic acid into the host cell genome. For purposes of expressing a MBM of the disclosure, a host cell can be a cell line of mammalian origin or mammalian-like characteristics, such as monkey kidney cells (COS, e.g., COS-1, COS-7), HEK293, baby hamster kidney (BHK, e.g., BHK21), Chinese hamster ovary (CHO), NSO, PerC6, BSC-1, human hepatocellular carcinoma cells (e.g., Hep G2), SP2/0, HeLa, Madin-Darby bovine kidney (MDBK), myeloma and lymphoma cells, or derivatives and/or engineered variants thereof. The engineered variants include, e.g., glycan profile modified and/or site-specific integration site derivatives.

Human Antibody: The term "human antibody" as used herein includes antibodies having variable regions in which both the framework and CDR regions are derived from sequences of human origin. Furthermore, if the antibody contains a constant region, the constant region also is derived from such human sequences, e.g., human germline sequences, or mutated versions of human germline sequences or antibody containing consensus framework sequences derived from human framework sequences analysis, for example, as described in Knappik et al., 2000, J Mol Biol 296, 57-86. The structures and locations of immunoglobulin variable domains, e.g., CDRs, can be defined using well known numbering schemes, e.g., the Kabat numbering scheme, the Chothia numbering scheme, or a combination of Kabat and Chothia (see, e.g., Lazikani et al., 1997, J. Mol. Bio. 273:927 948; Kabat et al., 1991, Sequences of Proteins of Immunological Interest, 5th edit., NIH Publication no. 91-3242 U.S. Department of Health and Human Services; Chothia et al., 1987, J. Mol. Biol. 196:901-917; Chothia et al., 1989, Nature 342:877-883).

Human antibodies can include amino acid residues not encoded by human sequences (e.g., mutations introduced by random or site-specific mutagenesis in vitro or by somatic mutation in vivo, or a conservative substitution to promote stability or manufacturing). However, the term "human antibody", as used herein, is not intended to include antibodies in which CDR sequences derived from the germline of another mammalian species, such as a mouse, have been grafted onto human framework sequences.

Humanized: The term "humanized" forms of non-human (e.g., murine) antibodies are chimeric antibodies that contain minimal sequence derived from non-human immunoglobulin. For the most part, humanized antibodies are human immunoglobulins (recipient antibody) in which residues from a hypervariable region of the recipient are replaced by residues from a hypervariable region of a non-human species (donor antibody) such as mouse, rat, rabbit or non-human primate having the desired specificity, affinity, and capacity. In some instances, framework region (FR) residues of the human immunoglobulin are replaced by corresponding non-human residues. Furthermore, humanized antibodies can comprise residues that are not found in the recipient antibody or in the donor antibody. These modifications are made to further refine antibody performance. In general, the humanized antibody will comprise substantially all of at least one, and typically two, variable domains, in which all or substantially all of the hypervariable loops correspond to those of a non-human immunoglobulin and all or substantially all of the FRs are those of a human immunoglobulin Io sequence. The humanized antibody optionally will also comprise at least a portion of an immunoglobulin constant region (Fc), typically that of a human immunoglobulin. For further details, see Jones et al., 1986, Nature 321:522-525; Riechmann et al., 1988, Nature 332:323-329; and Presta, 1992, Curr. Op. Struct. Biol. 2:593-596. See also the following review articles and references cited therein: Vaswani and Hamilton, 1998, Ann. Allergy, Asthma & Immunol. 1:105-115; Harris, 1995, Biochem. Soc. Transactions 23:1035-1038; Hurle and Gross, 1994, Curr. Op. Biotech. 5:428-433.

Knob: In the context of a knob-into-hole, a "knob" refers to at least one amino acid side chain which projects from the interface of a first Fc chain and is therefore positionable in a compensatory "hole" in the interface with a second Fc chain so as to stabilize the Fc heterodimer, and thereby favor Fc heterodimer formation over Fc homodimer formation, for example.

Knobs and holes (or knobs-into-holes): One mechanism for Fc heterodimerization is generally referred to in the art as "knobs and holes", or "knob-in-holes", or "knobs-into-holes". These terms refer to amino acid mutations that create steric influences to favor formation of Fc heterodimers over Fc homodimers, as described in, e.g., Ridgway et al., 1996, Protein Engineering 9(7):617; Atwell et al., 1997, J. Mol. Biol. 270:26; and U.S. Pat. No. 8,216,805. Knob-in-hole mutations can be combined with other strategies to improve heterodimerization, for example as described in Section 7.3.1.6.

Monoclonal Antibody: The term "monoclonal antibody" as used herein refers to polypeptides, including antibodies, antibody fragments, molecules (including TBMs), etc. that are derived from the same genetic source.

Monovalent: The term "monovalent" as used herein in the context of an antigen-binding molecule refers to an antigen-binding molecule that has a single antigen-binding domain.

Multispecific binding molecules: The term "multispecific binding molecules" or "MBMs" refers to molecules that specifically bind to at least two antigens and comprise two or more antigen-binding domains. The antigen-binding domains can each independently be an antibody fragment (e.g., scFv, Fab, nanobody), a ligand, or a non-antibody derived binder (e.g., fibronectin, Fynomer, DARPin).

Mutation or modification: In the context of the primary amino acid sequence of a polypeptide, the terms "modification" and "mutation" refer to an amino acid substitution, insertion, and/or deletion in the polypeptide sequence relative to a reference polypeptide. Additionally, the term "modification" further encompasses an alteration to an amino acid residue, for example by chemical conjugation (e.g., of a drug or polyethylene glycol moiety) or post-translational modification (e.g., glycosylation).

Nucleic Acid: The term "nucleic acid" is used herein interchangeably with the term "polynucleotide" and refers to deoxyribonucleotides or ribonucleotides and polymers thereof in either single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, and peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. Specifically, as detailed below, degenerate codon substitutions can be achieved by generating sequences in which the third position of one or more selected (or all) codons is substituted with mixed-base and/or deoxyinosine residues (Batzer et al., (1991) Nucleic Acid Res. 19:5081; Ohtsuka et al., (1985) J. Biol. Chem. 260: 2605-2608; and Rossolini et al., (1994) Mol. Cell. Probes 8:91-98).

Operably linked: The term "operably linked" refers to a functional relationship between two or more peptide or polypeptide domains or nucleic acid (e.g., DNA) segments. In the context of a fusion protein or other polypeptide, the term "operably linked" means that two or more amino acid segments are linked so as to produce a functional polypeptide. For example, in the context of a MBM of the disclosure, separate ABMs (or chains of an ABM) can be through peptide linker sequences. In the context of a nucleic acid encoding a fusion protein, such as a polypeptide chain of a MBM of the disclosure, "operably linked" means that the two nucleic acids are joined such that the amino acid sequences encoded by the two nucleic acids remain in-frame. In the context of transcriptional regulation, the term refers to the functional relationship of a transcriptional regulatory sequence to a transcribed sequence. For example, a promoter or enhancer sequence is operably linked to a coding sequence if it stimulates or modulates the transcription of the coding sequence in an appropriate host cell or other expression system.

Pentavalent: The term "pentavalent" as used herein in the context of an antigen-binding molecule (e.g., a TBM) refers to an antigen-binding molecule that has five antigen-binding domains. Pentavalent TBMs of the disclosure generally have either (a) two pairs of antigen-binding domains that each bind to the same antigen and a single antigen-binding domain that binds to the third antigen or (b) three antigen-binding domains that bind to the same antigen and two antigen-binding domains that each bind to a separate antigen. An example of a pentavalent TBM is shown schematically in FIG. 1T.

Polypeptide and Protein: The terms "polypeptide" and "protein" are used interchangeably herein to refer to a polymer of amino acid residues. The terms encompass amino acid polymers in which one or more amino acid residue is an artificial chemical mimetic of a corresponding naturally occurring amino acid, as well as to naturally occurring amino acid polymers and non-naturally occurring amino acid polymer. Additionally, the terms encompass amino acid polymers that are derivatized, for example, by synthetic derivatization of one or more side chains or termini, glycosylation, PEGylation, circular permutation, cyclization, linkers to other molecules, fusion to proteins or protein domains, and addition of peptide tags or labels.

Recognize: The term "recognize" as used herein refers to an ABM that finds and interacts (e.g., binds) with its epitope.

Sequence identity: Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see blast.ncbi.nlm.nih.gov/Blast.cgi. When using any of the aforementioned algorithms, the default parameters (for Window length, gap penalty, etc.) are used. In one embodiment, sequence identity is done using the BLAST algorithm, using default parameters.

Optionally, the identity is determined over a region that is at least about 50 nucleotides (or, in the case of a peptide or polypeptide, at least about 10 amino acids) in length, or in some cases over a region that is 100 to 500 or 1000 or more nucleotides (or 20, 50, 200 or more amino acids) in length. In some embodiments, the identity is determined over a defined domain, e.g., the VH or VL of an antibody. Unless specified otherwise, the sequence identity between two sequences is determined over the entire length of the shorter of the two sequences.

Single Chain Fab or scFab: The terms "single chain Fab" and "scFab" mean a polypeptide comprising an antibody heavy chain variable domain (VH), an antibody constant domain 1 (CH1), an antibody light chain variable domain (VL), an antibody light chain constant domain (CL) and a linker, such that the VH and VL are in association with one another and the CH1 and CL are in association with one another. In some embodiments, the antibody domains and the linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL. The linker can be a polypeptide of at least 30 amino acids, for example between 32 and 50 amino acids. The single chain Fabs are stabilized via the natural disulfide bond between the CL domain and the CH1 domain.

Single Chain Fv or scFv: The term "single-chain Fv" or "scFv" as used herein refers to antibody fragments comprise the VH and VL domains of an antibody, where these domains are present in a single polypeptide chain. The Fv polypeptide can further comprise a polypeptide linker between the VH and VL domains which enables the scFv to form the desired structure for antigen-binding. For a review of scFv see Plückthun in The Pharmacology of Monoclonal Antibodies, vol. 113, Rosenburg and Moore eds., (1994) Springer-Verlag, New York, pp. 269-315.

Specifically (or selectively) binds: The term "specifically (or selectively) binds" to an antigen or an epitope refers to a binding reaction that is determinative of the presence of a cognate antigen or an epitope in a heterogeneous population of proteins and other biologics. The binding reaction can be but need not be mediated by an antibody or antibody fragment, but can also be mediated by, for example, any type of ABM described in Section 7.2, such as a ligand, a DARPin, etc. An ABM typically also has a dissociation rate constant (KD) (koff/kon) of less than $5×10^{-2}$ M, less than $10^{-2}$ M, less than $5×10^{-3}$ M, less than $10^{-3}$ M, less than $5×10^{-4}$ M, less than $10^{-4}$ M, less than $5×10^{-5}$ M, less than $10^{-5}$ M, less than $5×10^{-6}$ M, less than $10^{-6}$ M, less than $5×10^{-7}$ M, less than $10^{-7}$ M, less than $5×10^{-8}$ M, less than $10^{-8}$ M, less than $5×10^{-9}$ M, or less than $10^{-9}$ M, and binds to the target antigen with an affinity that is at least two-fold greater than its affinity for binding to a non-specific antigen (e.g., HSA). The term "specifically binds" does not exclude cross-species reactivity. For example, an antigen-binding module (e.g., an antigen-binding fragment of an antibody) that "specifically binds" to an antigen from one species can also "specifically bind" to that antigen in one or more other species. Thus, such cross-species reactivity does not itself alter the classification of an antigen-binding module as a "specific" binder. In certain embodiments, an antigen-binding module (e.g., ABM1, ABM2 and/or ABM3) that specifically binds to a human antigen has cross-species reactivity with one or more non-human mammalian species, e.g., a primate species (including but not limited to one or more of *Macaca fascicularis, Macaca mulatta*, and *Macaca nemestrina*) or a rodent species, e.g., *Mus musculus*. In other embodiments, the antigen-binding module (e.g., ABM1, ABM2 and/or ABM3) does not have cross-species reactivity.

Subject: The term "subject" includes human and non-human animals. Non-human animals include all vertebrates, e.g., mammals and non-mammals, such as non-human primates, sheep, dog, cow, chickens, amphibians, and reptiles. Except when noted, the terms "patient" or "subject" are used herein interchangeably.

Tandem of VH Domains: The term "a tandem of VH domains (or VHs)" as used herein refers to a string of VH domains, consisting of multiple numbers of identical VH domains of an antibody. Each of the VH domains, except the last one at the end of the tandem, has its C-terminus connected to the N-terminus of another VH domain with or without a linker. A tandem has at least 2 VH domains, and in particular embodiments of the MBMs has 3, 4, 5, 6, 7, 8, 9, or 10 VH domains. The tandem of VH can be produced by joining the encoding nucleic acids of each VH domain in a desired order using recombinant methods with or without a linker (e.g., as described in Section 7.3.3) that enables them to be made as a single polypeptide chain. The N-terminus of the first VH domain in the tandem is defined as the N-terminus of the tandem, while the C-terminus of the last VH domain in the tandem is defined as the C-terminus of the tandem.

Tandem of VL Domains: The term "a tandem of VL domains (or VLs)" as used herein refers to a string of VL domains, consisting of multiple numbers of identical VL domains of an antibody. Each of the VL domains, except the last one at the end of the tandem, has its C-terminus connected to the N-terminus of another VL with or without a linker. A tandem has at least 2 VL domains, and in particular embodiments an MBM has 3, 4, 5, 6, 7, 8, 9, or 10 VL domains. The tandem of VL can be produced by joining the encoding nucleic acids of each VL domain in a desired order using recombinant methods with or without a linker (e.g., as described in Section 7.3.3) that enables them to be made as a single polypeptide chain. The N-terminus of the first VL domain in the tandem is defined as the N-terminus of the tandem, while the C-terminus of the last VL domain in the tandem is defined as the C-terminus of the tandem.

Target Antigen: By "target antigen" as used herein is meant the molecule that is bound non-covalently, reversibly and specifically by an antigen binding domain.

Tetravalent: The term "tetravalent" as used herein in the context of an antigen-binding molecule (e.g., a TBM) refers to an antigen-binding molecule that has four antigen-binding domains. Tetravalent TBMs of the disclosure generally have two antigen-binding domains that bind to the same antigen (e.g., BCMA) and two antigen-binding domains that each bind to a separate antigen (e.g., a component of a TCR complex and either CD2 or a TAA). Examples of tetravalent TBMs are shown schematically in FIGS. 1Q-1S.

Therapeutically effective amount: A "therapeutically effective amount" refers to an amount effective, at dosages and for periods of time necessary, to achieve a desired therapeutic result.

Treat, Treatment, Treating: As used herein, the terms "treat", "treatment" and "treating" refer to the reduction or amelioration of the progression, severity and/or duration of a disease or disorder (e.g., a proliferative disorder), or the amelioration of one or more symptoms (e.g., one or more discernible symptoms) of a disorder resulting from the administration of one or more MBMs (e.g., TBMs) of the disclosure. In some embodiments, the terms "treat", "treatment" and "treating" refer to the amelioration of at least one measurable physical parameter of a disorder, such as growth of a tumor, not necessarily discernible by the patient. In other embodiments the terms "treat", "treatment" and "treating" refer to the inhibition of the progression of a disorder, either physically by, e.g., stabilization of a discernible symptom, physiologically by, e.g., stabilization of a physical parameter, or both. In some embodiments, the terms "treat", "treatment" and "treating" can refer to the reduction or stabilization of tumor size or cancerous cell count.

Trispecific binding molecules: The term "trispecific binding molecules" or "TBMs" refers to molecules that specifically bind to three antigens and comprise three or more antigen-binding domains. The TBMs of the disclosure comprise at least one antigen-binding domain which is specific for BCMA, at least one antigen-binding domain which is specific for a component of a TCR complex, and at least one antigen-binding domain which is specific for CD2 or a TAA. The antigen-binding domains can each independently be an antibody fragment (e.g., scFv, Fab, nanobody), a ligand, or a non-antibody derived binder (e.g., fibronectin, Fynomer, DARPin). Representative TBMs are illustrated in FIG. 1. TBMs can comprise one, two, three, four or even more polypeptide chains. For example, the TBM illustrated in FIG. 1M comprises a single polypeptide chain comprising three scFvs connected by ABM linkers one a single polypeptide chain. The TBM illustrated in FIG. 1K comprises two polypeptide chains comprising three scFvs connected by, inter alia, an Fc domain. The TBM illustrated in FIG. 1J comprises three polypeptide chains forming an scFv, a ligand, and a Fab connected by, inter alia, an Fc domain. The TBM illustrated in FIG. 1C comprises four polypeptide chains forming three Fabs connected by, inter alia, an Fc domain. The TBM illustrated in FIG. 1U comprises 6 polypeptide chains forming four Fabs and two scFvs connected by, inter alia, an Fc domain.

Trivalent: The term "trivalent" as used herein in the context of an antigen-binding molecule (e.g., a TBM) refers to an antigen-binding molecule that has three antigen-binding domains. The TBMs of the disclosure are trispecific and specifically bind to BCMA, a component of a TCR complex, and CD2 or a TAA. Accordingly, the trivalent TBMs have three antigen-binding domains that each bind to a different antigen. Examples of trivalent TBMs are shown schematically in FIGS. 1B-1V.

Tumor: The term "tumor" is used interchangeably with the term "cancer" herein, e.g., both terms encompass solid and liquid, e.g., diffuse or circulating, tumors. As used herein, the term "cancer" or "tumor" includes premalignant, as well as malignant cancers and tumors.

Tumor-Associated Antigen: The term "tumor-associated antigen" or "TAA" refers to a molecule (typically a protein, carbohydrate, lipid or some combination thereof) that is expressed on the surface of a cancer cell, either entirely or as a fragment (e.g., MHC/peptide), and which is useful for the preferential targeting of a pharmacological agent to the cancer cell. In some embodiments, a TAA is a marker expressed by both normal cells and cancer cells, e.g., a lineage marker, e.g., CD19 on B cells. In some embodiments, a TAA is a cell surface molecule that is overexpressed in a cancer cell in comparison to a normal cell, for instance, 1-fold over expression, 2-fold overexpression, 3-fold overexpression or more in comparison to a normal cell. In some embodiments, a TAA is a cell surface molecule that is inappropriately synthesized in the cancer cell, for instance, a molecule that contains deletions, additions or mutations in comparison to the molecule expressed on a normal cell. In some embodiments, a TAA will be expressed exclusively on the cell surface of a cancer cell, entirely or as a fragment (e.g., MHC/peptide), and not synthesized or expressed on the surface of a normal cell. Accordingly, the term "TAA" encompasses antigens that are specific to cancer cells, sometimes referred to as tumor-specific antigens ("TSAs"). Although BCMA has features of a tumor-associated antigen, the terms "tumor-associated antigen" and "TAA" are used throughout the disclosure to refer to molecules other than BCMA.

Variable region: By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. A "variable heavy domain" can pair with a "variable light domain" to form an antigen binding domain ("ABD") or antigen-binding module ("ABM"). In addition, each variable domain comprises three hypervariable regions ("complementary determining regions," "CDRs") (CDR-H1, CDR-H2, CDR-H3 for the variable heavy domain and CDR-L1, CDR-L2, CDR-L3 for the variable light domain) and four framework (FR) regions, arranged from amino-terminus to carboxy-terminus in the following order: FR1-CDR1-FR2-CDR2-FR3-CDR3-FR4.

Vector: The term "vector" is intended to refer to a polynucleotide molecule capable of transporting another polynucleotide to which it has been linked. One type of vector is a "plasmid", which refers to a circular double stranded DNA loop into which additional DNA segments can be ligated. Another type of vector is a viral vector, where additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operably linked. Such vectors are referred to herein as "recombinant expression vectors" (or simply, "expression vectors"). In general, expression vectors of utility in recombinant DNA techniques are often in the form of plasmids. In the present specification, "plasmid" and "vector" can be used interchangeably as the plasmid is the most commonly used form of vector. However, the disclosure is intended to include such other forms of expression vectors, such as viral vectors (e.g., replication defective retroviruses, adenoviruses and adeno-associated viruses), which serve equivalent functions.

VH: The term "VH" refers to the variable region of an immunoglobulin heavy chain of an antibody, including the heavy chain of an Fv, scFv, dsFv or Fab.

VL: The term "VL" refers to the variable region of an immunoglobulin light chain, including the light chain of an Fv, scFv, dsFv or Fab.

VH-VL or VH-VL Pair: In reference to a VH-VL pair, whether on the same polypeptide chain or on different polypeptide chains, the terms "VH-VL" and "VH-VL pair" are used for convenience and are not intended to convey any particular orientation, unless the context dictates otherwise. Thus, a scFv comprising a "VH-VL" or "VH-VL pair" can have the VH and VL domains in any orientation, for example the VH N-terminal to the VL or the VL N-terminal to the VH.

7.2. Antigen Binding Modules

Typically, one or more ABMs of the MBMs comprise immunoglobulin-based antigen-binding domains, for example the sequences of antibody fragments or derivatives. These antibody fragments and derivatives typically include the CDRs of an antibody and can include larger fragments and derivatives thereof, e.g., Fabs, scFabs, Fvs, and scFvs.

Immunoglobulin-based ABMs can comprise modifications to framework residues within a VH and/or a VL, e.g. to improve the properties of a MBM containing the ABM. For example, framework modifications can be made to decrease immunogenicity of a MBM. One approach for making such framework modifications is to "back-mutate" one or more framework residues of the ABM to a corresponding germline sequence. Such residues can be identified by comparing framework sequences to germline sequences from which the ABM is derived. To "match" framework region sequences to desired germline configuration, residues can be "back-mutated" to a corresponding germline sequence by, for example, site-directed mutagenesis. MBMs having such "back-mutated" ABMs are intended to be encompassed by the disclosure.

Another type of framework modification involves mutating one or more residues within a framework region, or even within one or more CDR regions, to remove T-cell epitopes to thereby reduce potential immunogenicity of a MBM. This approach is also referred to as "deimmunization" and is described in further detail in U.S. Patent Publication No. 20030153043 by Carr et al.

ABMs can also be modified to have altered glycosylation, which can be useful, for example, to increase the affinity of a MBM for one or more of its antigens. Such carbohydrate modifications can be accomplished by, for example, altering one or more sites of glycosylation within an ABM sequence. For example, one or more amino acid substitutions can be made that result in elimination of one or more variable region framework glycosylation sites to thereby eliminate glycosylation at that site. Such aglycosylation may increase the affinity of the MBM for an antigen. Such an approach is described in, e.g., U.S. Pat. Nos. 5,714,350 and 6,350,861 by Co et al.

7.2.1. Immunoglobulin Based Modules

7.2.1.1. Fabs

In certain aspects, an ABM is a Fab domain. Fab domains can be produced by proteolytic cleavage of immunoglobulin molecules, using enzymes such as papain, or through recombinant expression. Fab domains typically comprise a CH1 domain attached to a VH domain which pairs with a CL domain attached to a VL domain.

In a wild-type immunoglobulin, the VH domain is paired with the VL domain to constitute the Fv region, and the CH1 domain is paired with the CL domain to further stabilize the binding module. A disulfide bond between the two constant domains can further stabilize the Fab domain.

For the MBMs (e.g., TBMs) of the disclosure, it is advantageous to use Fab heterodimerization strategies to permit the correct association of Fab domains belonging to the same ABM and minimize aberrant pairing of Fab domains belonging to different ABMs. For example, the Fab heterodimerization strategies shown in Table 1 below can be used:

TABLE 1

| | Fab Heterodimerization Strategies | | | | | |
|---|---|---|---|---|---|---|
| Name | STRATEGY | VH | CH1 | VL | CL | REFERENCE |
| F1 | CrossMabCH1-CL | WT | CL domain | WT | CH1 domain | Schaefer et al., 2011, Cancer Cell 2011; 20:472-86; PMID:22014573. |
| F2 | orthogonal Fab VHVRD1CH1CRD2 - VLVRD1CλCRD2 | 39K, 62E | H172A, F174G | 1R, 38D (36F) | L135Y, S176W | Lewis et al., 2014, Nat Biotechnol 32:191-8 |
| F3 | orthogonal Fab VHVRD2CH1 wt - VLVRD2Cλwt | 39Y | WT | 38R | WT | Lewis et al., 2014, Nat Biotechnol 32:191-8 |
| F4 | TCR CαCβ | 39K | TCRCα | 38D | TCR Cβ | Wu et al., 2015, MAbs 7:364-76 |
| F5 | CR3 | WT | T192E | WT | N137K, S114A | Golay at al., 2016, J Immunol 196:3199-211. |

TABLE 1-continued

| | | | Fab Heterodimerization Strategies | | |
|---|---|---|---|---|---|
| Name | STRATEGY | VH | CH1 | VL | CL | REFERENCE |
| F6 | MUT4 | WT | L143Q, S188V | WT | V133T, S176V | Golay at al., 2016, J Immunol 196:3199-211. |
| F7 | DuetMab | WT | F126C | WT | S121C | Mazor et al., 2015, MAbs 7:377-89; Mazor et al., 2015, MAbs 7:461-669. |

Accordingly, in certain embodiments, correct association between the two polypeptides of a Fab is promoted by exchanging the VL and VH domains of the Fab for each other or exchanging the CH1 and CL domains for each other, e.g., as described in WO 2009/080251.

Correct Fab pairing can also be promoted by introducing one or more amino acid modifications in the CH1 domain and one or more amino acid modifications in the CL domain of the Fab and/or one or more amino acid modifications in the VH domain and one or more amino acid modifications in the VL domain. The amino acids that are modified are typically part of the VH:VL and CH1:CL interface such that the Fab components preferentially pair with each other rather than with components of other Fabs.

In one embodiment, the one or amino acid modifications are limited to the conserved framework residues of the variable (VH, VL) and constant (CH1, CL) domains as indicated by the Kabat numbering of residues. Almagro, 2008, Frontiers In Bioscience 13:1619-1633 provides a definition of the framework residues on the basis of Kabat, Chothia, and IMGT numbering schemes.

In one embodiment, the modifications introduced in the VH and CH1 and/or VL and CL domains are complementary to each other. Complementarity at the heavy and light chain interface can be achieved on the basis of steric and hydrophobic contacts, electrostatic/charge interactions or any combination of the variety of interactions. The complementarity between protein surfaces is broadly described in the literature in terms of lock and key fit, knob into hole, protrusion and cavity, donor and acceptor etc., all implying the nature of structural and chemical match between the two interacting surfaces.

In one embodiment, the one or more introduced modifications introduce a new hydrogen bond across the interface of the Fab components. In one embodiment, the one or more introduced modifications introduce a new salt bridge across the interface of the Fab components. Exemplary substitutions are described in WO 2014/150973 and WO 2014/082179.

In some embodiments, the Fab domain comprises a 192E substitution in the CH1 domain and 114A and 137K substitutions in the CL domain, which introduces a salt-bridge between the CH1 and CL domains (see, Golay et al., 2016, J Immunol 196:3199-211).

In some embodiments, the Fab domain comprises a 143Q and 188V substitutions in the CH1 domain and 113T and 176V substitutions in the CL domain, which serves to swap hydrophobic and polar regions of contact between the CH1 and CL domain (see, Golay et al., 2016, J Immunol 196: 3199-211).

In some embodiments, the Fab domain can comprise modifications in some or all of the VH, CH1, VL, CL domains to introduce orthogonal Fab interfaces which promote correct assembly of Fab domains (Lewis et al., 2014

Nature Biotechnology 32:191-198). In an embodiment, 39K, 62E modifications are introduced in the VH domain, H172A, F174G modifications are introduced in the CH1 domain, 1R, 38D, (36F) modifications are introduced in the VL domain, and L135Y, S176W modifications are introduced in the CL domain. In another embodiment, a 39Y modification is introduced in the VH domain and a 38R modification is introduced in the VL domain.

Fab domains can also be modified to replace the native CH1:CL disulfide bond with an engineered disulfide bond, thereby increasing the efficiency of Fab component pairing. For example, an engineered disulfide bond can be introduced by introducing a 126C in the CH1 domain and a 121C in the CL domain (see, Mazor et al., 2015, MAbs 7:377-89).

Fab domains can also be modified by replacing the CH1 domain and CL domain with alternative domains that promote correct assembly. For example, Wu et al., 2015, MAbs 7:364-76, describes substituting the CH1 domain with the constant domain of the a T cell receptor and substituting the CL domain with the β domain of the T cell receptor, and pairing these domain replacements with an additional charge-charge interaction between the VL and VH domains by introducing a 38D modification in the VL domain and a 39K modification in the VH domain.

ABMs can comprise a single chain Fab fragment, which is a polypeptide consisting of an antibody heavy chain variable domain (VH), an antibody constant domain 1 (CH1), an antibody light chain variable domain (VL), an antibody light chain constant domain (CL) and a linker. In some embodiments, the antibody domains and the linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL. The linker can be a polypeptide of at least 30 amino acids, e.g., between 32 and 50 amino acids. The single chain Fab domains are stabilized via the natural disulfide bond between the CL domain and the CH1 domain.

In an embodiment, the antibody domains and the linker in the single chain Fab fragment have one of the following orders in N-terminal to C-terminal direction: a) VH-CH1-linker-VL-CL, or b) VL-CL-linker-VH-CH1. In some cases, VL-CL-linker-VH-CH1 is used.

In another embodiment, the antibody domains and the linker in the single chain Fab fragment have one of the following orders in N-terminal to C-terminal direction: a) VH-CL-linker-VL-CH1 or b) VL-CH1-linker-VH-CL.

Optionally in the single chain Fab fragment, additionally to the natural disulfide bond between the CL-domain and the CH1 domain, also the antibody heavy chain variable domain (VH) and the antibody light chain variable domain (VL) are disulfide stabilized by introduction of a disulfide bond between the following positions: i) heavy chain variable domain position 44 to light chain variable domain position 100, ii) heavy chain variable domain position 105 to light chain variable domain position 43, or iii) heavy chain variable domain position 101 to light chain variable domain position 100 (numbering according to EU index of Kabat).

Such further disulfide stabilization of single chain Fab fragments is achieved by the introduction of a disulfide bond between the variable domains VH and VL of the single chain Fab fragments. Techniques to introduce unnatural disulfide bridges for stabilization for a single chain Fv are described e.g. in WO 94/029350, Rajagopal et al., 1997, Prot. Engin. 10:1453-59; Kobayashi et al., 1998, Nuclear Medicine & Biology, 25:387-393; and Schmidt, et al., 1999, Oncogene 18:1711-1721. In one embodiment, the optional disulfide bond between the variable domains of the single chain Fab fragments is between heavy chain variable domain position 44 and light chain variable domain position 100. In one embodiment, the optional disulfide bond between the variable domains of the single chain Fab fragments is between heavy chain variable domain position 105 and light chain variable domain position 43 (numbering according to EU index of Kabat).

7.2.1.2. scFvs

Single chain Fv or "scFv" antibody fragments comprise the VH and VL domains of an antibody in a single polypeptide chain, are capable of being expressed as a single chain polypeptide, and retain the specificity of the intact antibody from which it is derived. Generally, the scFv polypeptide further comprises a polypeptide linker between the VH and VL domain that enables the scFv to form the desired structure for target binding. Examples of linkers suitable for connecting the VH and VL chains of an scFV are the ABM linkers identified in Section 7.3.3, for example any of the linkers designated L1 through L54.

Unless specified, as used herein an scFv can have the VL and VH variable regions in either order, e.g., with respect to the N-terminal and C-terminal ends of the polypeptide, the scFv can comprise VL-linker-VH or can comprise VH-linker-VL.

To create an scFv-encoding nucleic acid, the VH and VL-encoding DNA fragments are operably linked to another fragment encoding a linker, e.g., encoding any of the ABM linkers described in Section 7.3.3 (such as the amino acid sequence (Gly4ˉSer)3 (SEQ ID NO: 1)), such that the VH and VL sequences can be expressed as a contiguous single-chain protein, with the VL and VH regions joined by the flexible linker (see e.g., Bird et al., 1988, Science 242:423-426; Huston et al., 1988, Proc. Natl. Acad. Sci. USA 85:5879-5883; McCafferty et al., 1990, Nature 348:552-554).

7.2.1.3. Other Immunoglobulin-Based Modules

MBMs can also comprise ABMs having an immunoglobulin format which is other than Fab or scFv, for example Fv, dsFv, (Fab')2, a single domain antibody (SDAB), a VH or VL domain, or a camelid VHH domain (also called a nanobody).

An ABM can be a single domain antibody composed of a single VH or VL domain which exhibits sufficient affinity to the target. In some embodiments, the single domain antibody is a camelid VHH domain (see, e.g., Riechmann, 1999, Journal of Immunological Methods 231:25-38; WO 94/04678).

7.2.2. Non-Immunoglobulin Based Modules

In certain embodiments, one or more of the ABMs are derived from non-antibody scaffold proteins (including, but not limited to, designed ankyrin repeat proteins (DARPins), Avimers (short for avidity multimers), Anticalin/Lipocalins, Centyrins, Kunitz domains, Adnexins, Affilins, Affitins (also known as Nonfitins), Knottins, Pronectins, Versabodies, Duocalins, and Fynomers), ligands, receptors, cytokines or chemokines.

Non-immunoglobulin scaffolds that can be used in the MBMs include those listed in Tables 3 and 4 of Mintz and Crea, 2013, Bioprocess International 11(2):40-48; in FIG. 1, Table 1 and Figure I of Vazquez-Lombardi et al., 2015, Drug Discovery Today 20(10):1271-83; in Table 1 and Box 2 of Skrlec et al., 2015, Trends in Biotechnology 33(7):408-18. The contents of Tables 3 and 4 of Mintz and Crea, 2013, Bioprocess International 11(2):40-48; in FIG. 1, Table 1 and Figure I of Vazquez-Lombardi et al., 2015, Drug Discovery Today 20(10):1271-83; in Table 1 and Box 2 of Skrlec et al., 2015, Trends in Biotechnology 33(7):408-18 (collectively, "Scaffold Disclosures"). In a particular embodiment, the Scaffold Disclosures are incorporated by reference for what they disclose relating to Adnexins. In another embodiment, the Scaffold Disclosures are incorporated by reference for what they disclose relating to Avimers. In another embodiment, the Scaffold Disclosures are incorporated by reference for what they disclose relating to Affibodies. In yet another embodiment, the Scaffold Disclosures are incorporated by reference for what they disclose relating to Anticalins. In yet another embodiment, the Scaffold Disclosures are incorporated by reference for what they disclose relating to DARPins. In yet another embodiment, the Scaffold Disclosures are incorporated by reference for what they disclose relating to Kunitz domains. In yet another embodiment, the Scaffold Disclosures are incorporated by reference for what they disclose relating to Knottins. In yet another embodiment, the Scaffold Disclosures are incorporated by reference for what they disclose relating to Pronectins. In yet another embodiment, the Scaffold Disclosures are incorporated by reference for what they disclose relating to Nanofitins. In yet another embodiment, the Scaffold Disclosures are incorporated by reference for what they disclose relating to Affilins. In yet another embodiment, the Scaffold Disclosures are incorporated by reference for what they disclose relating to Adnectins. In yet another embodiment, the Scaffold Disclosures are incorporated by reference for what they disclose relating to ABDs. In yet another embodiment, the Scaffold Disclosures are incorporated by reference for what they disclose relating to Adhirons. In yet another embodiment, the Scaffold Disclosures are incorporated by reference for what they disclose relating to Affimers. In yet another embodiment, the Scaffold Disclosures are incorporated by reference for what they disclose relating to Alphabodies. In yet another embodiment, the Scaffold Disclosures are incorporated by reference for what they disclose relating to Armadillo Repeat Proteins. In yet another embodiment, the Scaffold Disclosures are incorporated by reference for what they disclose relating to Atrimers/Tetranectins. In yet another embodiment, the Scaffold Disclosures are incorporated by reference for what they disclose relating to Obodies/OB-folds. In yet another embodiment, the Scaffold Disclosures are incorporated by reference for what they disclose relating to Centyrins. In yet another embodiment, the Scaffold Disclosures are incorporated by reference for what they disclose relating to Repebodies. In yet another embodiment, the Scaffold Disclosures are incorporated by reference for what they disclose relating to Anticalins. In yet another embodiment, the Scaffold Disclosures are incorporated by reference for what they disclose relating to Atrimers. In yet another embodiment, the Scaffold Disclosures are incorporated by reference for what they disclose relating to bicyclic peptides. In yet another embodiment, the Scaffold Disclosures are incorporated by reference for what they disclose relating to cys-knots. In yet another embodiment, the Scaf-fold Disclosures are incorporated by reference for what they disclose relating to Fn3 scaffolds (including Adnectins, Centryrins, Pronectins, and Tn3).

In an embodiment, an ABM can be a designed ankyrin repeat protein ("DARPin"). DARPins are antibody mimetic proteins that typically exhibit highly specific and high-affinity target protein binding. They are typically genetically engineered and derived from natural ankyrin proteins and consist of at least three, usually four or five repeat motifs of these proteins. Their molecular mass is about 14 or 18 kDa (kilodaltons) for four- or five-repeat DARPins, respectively. Examples of DARPins can be found, for example in U.S. Pat. No. 7,417,130. Multispecific binding molecules com-prising DARPin binding modules and immunoglobulin-based binding modules are disclosed in, for example, U.S. Publication No. 2015/0030596 A1.

In another embodiment, an ABM can be an Affibody. An Affibody is well known and refers to affinity proteins based on a 58 amino acid residue protein domain, derived from one of the IgG binding domain of staphylococcal protein A.

In another embodiment, an ABM can be an Anticalin. Anticalins are well known and refer to another antibody mimetic technology, where the binding specificity is derived from Lipocalins. Anticalins can also be formatted as dual targeting protein, called Duocalins.

In another embodiment, an ABM can be a Versabody. Versabodies are well known and refer to another antibody mimetic technology. They are small proteins of 3-5 kDa with >15% cysteines, which form a high disulfide density scaf-fold, replacing the hydrophobic core of typical proteins.

Other non-immunoglobulin ABMs include "A" domain oligomers (also known as Avimers) (see for example, U.S. Patent Application Publication Nos. 2005/0164301, 2005/0048512, and 2004/017576), Fn3 based protein scaffolds (see for example, U.S. Patent Application Publication 2003/0170753), VASP polypeptides, Avian pancreatic polypeptide (aPP), Tetranectin (based on CTLD3), Affililin (based on γB-crystallin/ubiquitin), Knottins, SH3 domains, PDZ domains, Tendamistat, Neocarzinostatin, Protein A domains, Lipocalins, Transferrin, or Kunitz domains. In one aspect, ABMs useful in the construction of the MBMs comprise fibronectin-based scaffolds as exemplified in WO 2011/130324.

7.3. Connectors

It is contemplated that the MBMs can in some instances include pairs of ABMs or ABM chains (e.g., the VH-CH1 or VL-CL component of a Fab) connected directly to one another, e.g., as a fusion protein without a linker. For example, the MBMs comprise connector moieties linking individual ABMs or ABM chains. The use of connector moieties can improve target binding, for example by increas-ing flexibility of the ABMs within a MBM and thus reducing steric hindrance. The ABMs can be connected to one another through, for example, Fc domains (each Fc domain repre-senting a pair of associated Fc regions) and/or ABM linkers. The use of Fc domains will typically require the use of hinge regions as connectors of the ABMs or ABM chains for optimal antigen binding. Thus, the term "connector" encom-passes, but is not limited to, Fc regions, Fc domains, hinge regions, and ABM linkers.

Connectors can be selected or modified to, for example, increase or decrease the biological half-life of a MBM of the disclosure. For example, to decrease biological half-life, one or more amino acid mutations can be introduced into a CH2-CH3 domain interface region of an Fc-hinge fragment such that a MBM comprising the fragment has impaired Staphylococcyl Protein A (SpA) binding relative to native Fc-hinge domain SpA binding. This approach is described in further detail in U.S. Pat. No. 6,165,745 by Ward et al. Alternatively, a MBM can be modified to increase its biological half-life. For example, one or more of the fol-lowing mutations can be introduced: T252L, T254S, T256F, as described in U.S. Pat. No. 6,277,375 to Ward. Alterna-tively, to increase the biological half-life, a MBM can be altered within a CH1 or CL region to contain a salvage receptor binding epitope taken from two loops of a CH2 domain of an Fc region of an IgG, as described in U.S. Pat. Nos. 5,869,046 and 6,121,022 by Presta et al.

Examples of Fc domains (formed by the pairing of two Fc regions), hinge regions and ABM linkers are described in Sections 7.3.1, 7.3.2, and 7.3.3, respectively.

7.3.1. Fc Domains

The MBMs (e.g., TBMs) can include an Fc domain derived from any suitable species. In one embodiment, the Fc domain is derived from a human Fc domain.

The Fc domain can be derived from any suitable class of antibody, including IgA (including subclasses IgA1 and IgA2), IgD, IgE, IgG (including subclasses IgG1, IgG2, IgG3 and IgG4), and IgM. In one embodiment, the Fc domain is derived from IgG1, IgG2, IgG3 or IgG4. In one embodiment, the Fc domain is derived from IgG1. In one embodiment, the Fc domain is derived from IgG4.

The Fc domain comprises two polypeptide chains, each referred to as a heavy chain Fc region. The two heavy chain Fc regions dimerize to create the Fc domain. The two Fc regions within the Fc domain can be the same or different from one another. In a native antibody the Fc regions are typically identical, but for the purpose of producing multi-specific binding molecules, e.g., the TBMs of the disclosure, the Fc regions might advantageously be different to allow for heterodimerization, as described in Section 7.3.1.5 below.

Typically each heavy chain Fc region comprises or con-sists of two or three heavy chain constant domains.

In native antibodies, the heavy chain Fc region of IgA, IgD and IgG is composed of two heavy chain constant domains (CH2 and CH3) and that of IgE and IgM is composed of three heavy chain constant domains (CH2, CH3 and CH4). These dimerize to create an Fc domain.

In the present disclosure, the heavy chain Fc region can comprise heavy chain constant domains from one or more different classes of antibody, for example one, two or three different classes.

In one embodiment, the heavy chain Fc region comprises CH2 and CH3 domains derived from IgG1. An exemplary sequence of a heavy chain Fc region derived from human IgG1 is given in SEQ ID NO:872:

```
                                    (SEQ ID NO: 872)
DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKE

YKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSR

WQQGNVFSCSVMHEALHNHYTQKSLSLSP.
```

In some embodiments, a MBM of the disclosure com-prises a Fc region whose amino acid sequence comprises the amino acid sequence of SEQ ID NO:872 modified with one or more of the substitutions described in Section 7.3.1 and its subparts.

In one embodiment, the heavy chain Fc region comprises CH2 and CH3 domains derived from IgG2.

In one embodiment, the heavy chain Fc region comprises CH2 and CH3 domains derived from IgG3.

In one embodiment, the heavy chain Fc region comprises CH2 and CH3 domains derived from IgG4.

In one embodiment, the heavy chain Fc region comprises a CH4 domain from IgM. The IgM CH4 domain is typically located at the C-terminus of the CH3 domain.

In one embodiment, the heavy chain Fc region comprises CH2 and CH3 domains derived from IgG and a CH4 domain derived from IgM.

It will be appreciated that the heavy chain constant domains for use in producing a heavy chain Fc region for the MBMs of the present disclosure can include variants of the naturally occurring constant domains described above. Such variants can comprise one or more amino acid variations compared to wild type constant domains. In one example the heavy chain Fc region of the present disclosure comprises at least one constant domain that varies in sequence from the wild type constant domain. It will be appreciated that the variant constant domains can be longer or shorter than the wild type constant domain. For example, the variant constant domains are at least 60% identical or similar to a wild type constant domain. In another example the variant constant domains are at least 70% identical or similar. In another example the variant constant domains are at least 75% identical or similar. In another example the variant constant domains are at least 80% identical or similar. In another example the variant constant domains are at least 85% identical or similar. In another example the variant constant domains are at least 90% identical or similar. In another example the variant constant domains are at least 95% identical or similar. In another example the variant constant domains are at least 99% identical or similar. Exemplary Fc variants are described in Sections 7.3.1.1 through 7.3.1.5, infra.

IgM and IgA occur naturally in humans as covalent multimers of the common H2L2 antibody unit. IgM occurs as a pentamer when it has incorporated a J-chain, or as a hexamer when it lacks a J-chain. IgA occurs as monomer and dimer forms. The heavy chains of IgM and IgA possess an 18 amino acid extension to the C-terminal constant domain, known as a tailpiece. The tailpiece includes a cysteine residue that forms a disulfide bond between heavy chains in the polymer, and is believed to have an important role in polymerization. The tailpiece also contains a glycosylation site. In certain embodiments, the MBMs of the present disclosure do not comprise a tailpiece.

The Fc domains that are incorporated into the MBMs (e.g., TBMs) of the present disclosure can comprise one or more modifications that alter one or more functional properties of the proteins, such as serum half-life, complement fixation, Fc receptor binding, and/or antigen-dependent cellular cytotoxicity. Furthermore, a MBM can be chemically modified (e.g., one or more chemical moieties can be attached to the MBM) or be modified to alter its glycosylation, again to alter one or more functional properties of the MBM.

Effector function of an antibody molecule includes complement-mediated effector function, which is mediated by, for example, binding of the C1 component of the complement to the antibody. Activation of complement is important in the opsonization and direct lysis of pathogens.

In addition, it stimulates the inflammatory response by recruiting and activating phagocytes to the site of complement activation. Effector function includes Fc receptor (FcR)-mediated effector function, which can be triggered upon binding of the constant domains of an antibody to an Fc receptor (FcR). Antigen-antibody complex-mediated crosslinking of Fc receptors on effector cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production.

Fc regions can be altered by replacing at least one amino acid residue with a different amino acid residue to alter the effector functions. For example, one or more amino acids can be replaced with a different amino acid residue such that the Fc region has an altered affinity for an effector ligand. The effector ligand to which affinity is altered can be, for example, an Fc receptor or the C1 component of complement. This approach is described in, e.g., U.S. Pat. Nos. 5,624,821 and 5,648,260, both by Winter et al. Modified Fc regions can also alter C1q binding and/or reduce or abolish complement dependent cytotoxicity (CDC). This approach is described in, e.g., U.S. Pat. No. 6,194,551 by Idusogie et al. Modified Fc regions can also alter the ability of an Fc region to fix complement. This approach is described in, e.g., the PCT Publication WO 94/29351 by Bodmer et al. Allotypic amino acid residues include, but are not limited to, constant region of a heavy chain of the IgG1, IgG2, and IgG3 subclasses as well as constant region of a light chain of the kappa isotype as described by Jefferis et al., 2009, MAbs, 1:332-338.

Fc regions can also be modified to "silence" the effector function, for example, to reduce or eliminate the ability of a MBM to mediate antibody dependent cellular cytotoxicity (ADCC) and/or antibody dependent cellular phagocytosis (ADCP). This can be achieved, for example, by introducing a mutation in an Fc region. Such mutations have been described in the art: LALA and N297A (Strohl, 2009, Curr. Opin. Biotechnol. 20(6):685-691); and D265A (Baudino et al., 2008, J. Immunol. 181: 6664-69; Strohl, supra). Examples of silent Fc IgG1 antibodies comprise the so-called LALA mutant comprising L234A and L235A mutation in the IgG1 Fc amino acid sequence. Another example of a silent IgG1 antibody comprises the D265A mutation. Another silent IgG1 antibody comprises the so-called DAPA mutant comprising D265A and P329A mutations in the IgG1 Fc amino acid sequence. Another silent IgG1 antibody comprises the N297A mutation, which results in aglycosylated/non-glycosylated antibodies.

Fc regions can be modified to increase the ability of a MBM containing the Fc region to mediate antibody dependent cellular cytotoxicity (ADCC) and/or antibody dependent cellular phagocytosis (ADCP), for example, by modifying one or more amino acid residues to increase the affinity of the MBM for an activating Fcγ receptor, or to decrease the affinity of the MBM for an inhibitory Fcγ receptor. Human activating Fcγ receptors include FcγRIa, FcγRIIa, FcγRIIIa, and FcγRIIIb, and human inhibitory Fcγ receptor includes FcγRIIb. This approach is described in, e.g., the PCT Publication WO0/42072 by Presta. Moreover, binding sites on human IgG1 for FcγRI, FcγRII, FcγRIII and FcRn have been mapped and variants with improved binding have been described (see Shields et al., J. Biol. Chem. 276:6591-6604, 2001). Optimization of Fc-mediated effector functions of monoclonal antibodies such as increased ADCC/ADCP function has been described (see Stroh, 2009, Current Opinion in Biotechnology 20:685-691). Mutations that can enhance ADCC/ADCP function include one or more mutations selected from G236A, S239D, F243L, P2471, D280H, K290S, R292P, S298A, S298D, S298V, Y300L, V3051, A330L, I332E, E333A, K334A, A339D, A339Q, A339T, and P396L (all positions by EU numbering).

Fc regions can also be modified to increase the ability of a MBM to mediate ADCC and/or ADCP, for example, by modifying one or more amino acids to increase the affinity of the MBM for an activating receptor that would typically not recognize the parent MBM, such as FcαRI. This approach is described in, e.g., Borrok et al., 2015, mAbs. 7(4):743-751.

Accordingly, in certain aspects, the MBMs of the present disclosure can include Fc domains with altered effector function such as, but not limited to, binding to Fc-receptors such as FcRn or leukocyte receptors (for example, as described above or in Section 7.3.1.1), binding to complement (for example as described above or in Section 7.3.1.2), modified disulfide bond architecture (for example as described above or in Section 7.3.1.3), or altered glycosylation patterns (for example as described above or in Section 7.3.1.4). The Fc domains can also be altered to include modifications that improve manufacturability of asymmetric MBMs, for example by allowing heterodimerization, which is the preferential pairing of non-identical Fc regions over identical Fc regions. Heterodimerization permits the production of MBMs in which different ABMs are connected to one another by an Fc domain containing Fc regions that differ in sequence. Examples of heterodimerization strategies are exemplified in Section 7.3.1.5 (and subsections thereof).

It will be appreciated that any of the modifications described in Sections 7.3.1.1 through 7.3.1.5 can be combined in any suitable manner to achieve the desired functional properties and/or combined with other modifications to alter the properties of the MBMs. In some embodiments, a MBM comprises a IgG1 Fc domain having a mutation at 1, 2, 3, 4, 5, 6, or more than 6 positions 233, 234, 235, 236, 237, 239, 265, 266, 267, 268, 269, 297, 299, 322, 327, 328, 329, 330, 331 and 332 (EU numbering). For example, a MBM can comprise an IgG1 sequence of SEQ ID NO:872 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332

7.3.1.1. Fc Domains with Altered FcR Binding

The Fc domains of the MBMs (e.g., TBMs) can show altered binding to one or more Fc-receptors (FcRs) in comparison with the corresponding native immunoglobulin. The binding to any particular Fc-receptor can be increased or decreased. In one embodiment, the Fc domain comprises one or more modifications which alter its Fc-receptor binding profile.

Human cells can express a number of membrane bound FcRs selected from FcαR, FcεR, FcγR, FcRn and glycan receptors. Some cells are also capable of expressing soluble (ectodomain) FcR (Fridman et al., 1993, J Leukocyte Biology 54: 504-512). FcγR can be further divided by affinity of IgG binding (high/low) and biological effect (activating/inhibiting). Human FcγRI is widely considered to be the sole 'high affinity' receptor whilst all of the others are considered as medium to low. FcγRIIb is the sole receptor with 'inhibitory' functionality by virtue of its intracellular ITIM motif whilst all of the others are considered as 'activating' by virtue of ITAM motifs or pairing with the common FcγR—

γchain. FcγRIIIb is also unique in that although activatory it associates with the cell via a GPI anchor. In total, humans express six "standard" FcγRs: FcγRI, FcγRIIa, FcγRIIb, FcγRIIc, FcγRIIIa, and FcγRIIIb. In addition to these sequences there are a large number of sequence or allotypic variants spread across these families. Some of these have been found to have important functional consequence and so are sometimes considered to be receptor sub-types of their own. Examples include $FcγRIIH^{H134R}$, $FcγRIIb^{I190T}$, $FcγRIIIa^{F158V}$, $FcγRIIIb^{NA1}$, $FcγRIIIb^{NA2}$, and $FcγRIII^{SH}$. Each receptor sequence has been shown to have different affinities for the 4 sub-classes of IgG: IgG1, IgG2, IgG3 and IgG4 (Bruhns, 1993, Blood 113:3716-3725). Other species have somewhat different numbers and functionality of FcγR, with the mouse system being the best studied to date and comprising of 4 FcγR, FcγRI FcγRIIb FcγRIII FcγRIV (Bruhns, 2012, Blood 119:5640-5649). Human FcγRI on cells is normally considered to be 'occupied' by monomeric IgG in normal serum conditions due to its affinity for IgG1/IgG3/IgG4 (about $10^{-8}$ M) and the concentration of these IgG in serum (about 10 mg/ml). Hence cells bearing FcγRI on their surface are considered to be capable for "screening" or "sampling" of their antigenic environment vicariously through the bound polyspecific IgG. The other receptors having lower affinities for IgG sub-classes (in the range of about $10^{-5}$-$10^{-7}$ M) are normally considered to be "unoccupied." The low affinity receptors are hence inherently sensitive to the detection of and activation by antibody involved immune complexes. The increased Fc density in an antibody immune complex results in increased functional affinity of binding avidity to low affinity FcγR. This has been demonstrated in vitro using a number of methods (Shields et al., 2001, J Biol Chem 276(9):6591-6604; Lux et al., 2013, J Immunol 190:4315-4323). It has also been implicated as being one of the primary modes of action in the use of anti-RhD to treat ITP in humans (Crow, 2008, Transfusion Medicine Reviews 22:103-116).

Many cell types express multiple types of FcγR and so binding of IgG or antibody immune complex to cells bearing FcγR can have multiple and complex outcomes depending upon the biological context. Most simply, cells can either receive an activatory, inhibitory or mixed signal. This can result in events such as phagocytosis (e.g., macrophages and neutrophils), antigen processing (e.g., dendritic cells), reduced IgG production (e.g., B-cells) or degranulation (e.g., neutrophils, mast cells). There are data to support that the inhibitory signal from FcγRIIb can dominate that of activatory signals (Proulx, 2010, Clinical Immunology 135:422-429).

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction where nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present disclosure include those listed in US 2006/0024298 (particularly FIG. 41), US 2006/0121032, US 2006/0235208, US 2007/0148170, and US 2019/0100587. Particular variants that find use include, but are not limited to, 236A, 239D, 239E, 332E, 332D, 239D, 332E, 267D, 267E, 328F, 267E, 328F, 236A, 332E, 239D, 332E, 330Y, 239D, 332E, 330L, 243A, 243L, 264A, 264V, 299T, 265A, 297A, 329A, 265N, 297D, 329G, and 265E, 297Q, 329S.

FcRn has a crucial role in maintaining the long half-life of IgG in the serum of adults and children. The receptor binds IgG in acidified vesicles (pH<6.5) protecting the IgG molecule from degradation, and then releasing it at the higher pH of 7.4 in blood.

FcRn is unlike leukocyte Fc receptors, and instead, has structural similarity to MHC class I molecules. It is a heterodimer composed of a $\beta_2$-microglobulin chain, non-covalently attached to a membrane-bound chain that includes three extracellular domains. One of these domains, including a carbohydrate chain, together with $\beta_2$-micro-globulin interacts with a site between the CH2 and CH3 domains of Fc. The interaction includes salt bridges made to histidine residues on IgG that are positively charged at pH<6.5. At higher pH, the His residues lose their positive charges, the FcRn-IgG interaction is weakened and IgG dissociates.

In one embodiment, a MBM comprises an Fc domain that binds to human FcRn.

In one embodiment, the Fc domain has an (e.g., one or two) Fc regions comprising a histidine residue at position 310, and in some cases also at position 435. These histidine residues are important for human FcRn binding. In one embodiment, the histidine residues at positions 310 and 435 are native residues, i.e., positions 310 and 435 are not modified. Alternatively, one or both of these histidine residues can be present as a result of a modification.

The MBMs can comprise one or more Fc regions that alter Fc binding to FcRn. The altered binding can be increased binding or decreased binding.

In one embodiment, the MBM comprises an Fc domain in which at least one (and optionally both) Fc regions comprises one or more modifications such that it binds to FcRn with greater affinity and avidity than the corresponding native immunoglobulin.

Fc substitutions that increase binding to the FcRn receptor and increase serum half life are described in US 2009/0163699, including, but not limited to, 434S, 434A, 428L, 308F, 259I, 428L, 434S, 259I/308F, 436I/428L, 436I or V, 434S, 436V, 428L and 259I/308F, 428L.

In one embodiment, the Fc region is modified by substituting the threonine residue at position 250 with a glutamine residue (T250Q).

In one embodiment, the Fc region is modified by substituting the methionine residue at position 252 with a tyrosine residue (M252Y)

In one embodiment, the Fc region is modified by substituting the serine residue at position 254 with a threonine residue (S254T).

In one embodiment, the Fc region is modified by substituting the threonine residue at position 256 with a glutamic acid residue (T256E).

In one embodiment, the Fc region is modified by substituting the threonine residue at position 307 with an alanine residue (T307A).

In one embodiment, the Fc region is modified by substituting the threonine residue at position 307 with a proline residue (T307P).

In one embodiment, the Fc region is modified by substituting the valine residue at position 308 with a cysteine residue (V308C).

In one embodiment, the Fc region is modified by substituting the valine residue at position 308 with a phenylalanine residue (V308F).

In one embodiment, the Fc region is modified by substituting the valine residue at position 308 with a proline residue (V308P).

In one embodiment, the Fc region is modified by substituting the glutamine residue at position 311 with an alanine residue (Q311A).

In one embodiment, the Fc region is modified by substituting the glutamine residue at position 311 with an arginine residue (Q311R).

In one embodiment, the Fc region is modified by substituting the methionine residue at position 428 with a leucine residue (M428L).

In one embodiment, the Fc region is modified by substituting the histidine residue at position 433 with a lysine residue (H433K).

In one embodiment, the Fc region is modified by substituting the asparagine residue at position 434 with a phenylalanine residue (N434F).

In one embodiment, the Fc region is modified by substituting the asparagine residue at position 434 with a tyrosine residue (N434Y).

In one embodiment, the Fc region is modified by substituting the methionine residue at position 252 with a tyrosine residue, the serine residue at position 254 with a threonine residue, and the threonine residue at position 256 with a glutamic acid residue (M252Y/S254T/T256E).

In one embodiment, the Fc region is modified by substituting the valine residue at position 308 with a proline residue and the asparagine residue at position 434 with a tyrosine residue (V308P/N434Y).

In one embodiment, the Fc region is modified by substituting the methionine residue at position 252 with a tyrosine residue, the serine residue at position 254 with a threonine residue, the threonine residue at position 256 with a glutamic acid residue, the histidine residue at position 433 with a lysine residue and the asparagine residue at position 434 with a phenylalanine residue (M252Y/S254T/T256E/H433K/N434F).

It will be appreciated that any of the modifications listed above can be combined to alter FcRn binding.

In one embodiment, the MBM comprises an Fc domain in which one or both Fc regions comprise one or more modifications such that the Fc domain binds to FcRn with lower affinity and avidity than the corresponding native immunoglobulin.

In one embodiment, the Fc region comprises any amino acid residue other than histidine at position 310 and/or position 435.

The MBM can comprise an Fc domain in which one or both Fc regions comprise one or more modifications which increase its binding to FcγRIIb. FcγRIIb is the only inhibitory receptor in humans and the only Fc receptor found on B cells.

In one embodiment, the Fc region is modified by substituting the proline residue at position 238 with an aspartic acid residue (P238D).

In one embodiment, the Fc region is modified by substituting the glutamic acid residue at position 258 with an alanine residue (E258A).

In one embodiment, the Fc region is modified by substituting the serine residue at position 267 with an alanine residue (S267A).

In one embodiment, the Fc region is modified by substituting the serine residue at position 267 with a glutamic acid residue (S267E).

In one embodiment, the Fc region is modified by substituting the leucine residue at position 328 with a phenylalanine residue (L328F).

In one embodiment, the Fc region is modified by substituting the glutamic acid residue at position 258 with an alanine residue and the serine residue at position 267 with an alanine residue (E258A/S267A).

In one embodiment, the Fc region is modified by substituting the serine residue at position 267 with a glutamic acid residue and the leucine residue at position 328 with a phenylalanine residue (S267E/L328F).

It will be appreciated that any of the modifications listed above can be combined to increase FcγRIIb binding.

In one embodiment, MBMs are provided comprising Fc domains which display decreased binding to FcγR.

In one embodiment, an MBM comprises an Fc domain in which one or both Fc regions comprise one or more modifications that decrease Fc binding to FcγR.

The Fc domain can be derived from IgG1.

In one embodiment, the Fc region is modified by substituting the leucine residue at position 234 with an alanine residue (L234A).

In one embodiment, the Fc region is modified by substituting the leucine residue at position 235 with an alanine residue (L235A).

In one embodiment, the Fc region is modified by substituting the glycine residue at position 236 with an arginine residue (G236R).

In one embodiment, the Fc region is modified by substituting the asparagine residue at position 297 with an alanine residue (N297A) or a glutamine residue (N297Q).

In one embodiment, the Fc region is modified by substituting the serine residue at position 298 with an alanine residue (S298A).

In one embodiment, the Fc region is modified by substituting the leucine residue at position 328 with an arginine residue (L328R).

In one embodiment, the Fc region is modified by substituting the leucine residue at position 234 with an alanine residue and the leucine residue at position 235 with an alanine residue (L234A/L235A).

In one embodiment, the Fc region is modified by substituting the phenylalanine residue at position 234 with an alanine residue and the leucine residue at position 235 with an alanine residue (F234A/L235A).

In one embodiment, the Fc region is modified by substituting the glycine residue at position 236 with an arginine residue and the leucine residue at position 328 with an arginine residue (G236R/L328R).

In one embodiment, the Fc region is modified by substituting the aspartate residue at position 265 with an alanine residue, the asparagine residue at position 297 with an alanine residue and the proline residue at position 329 with an alanine residue (D265A/N297A/P329A).

In one embodiment, the Fc region is modified by substituting the aspartate residue at position 265 with an asparagine residue, the asparagine residue at position 297 with an aspartate residue and the proline residue at position 329 with a glycine residue (D265N/N297D/P329G).

In one embodiment, the Fc region is modified by substituting the aspartate residue at position 265 with a glutamate residue, the asparagine residue at position 297 with an glutamine residue and the proline residue at position 329 with a serine residue (D265E/N297Q/P329S).

It will be appreciated that any of the modifications listed above can be combined to decrease FcγR binding.

In one embodiment, a MBM comprises an Fc domain in which one or both Fc regions comprise one or more modifications that decrease Fc binding to FcγRIIIa without affecting the Fc's binding to FcγRII.

In one embodiment, the Fc region is modified by substituting the serine residue at position 239 with an alanine residue (S239A).

In one embodiment, the Fc region is modified by substituting the glutamic acid residue at position 269 with an alanine residue (E269A).

In one embodiment, the Fc region is modified by substituting the glutamic acid residue at position 293 with an alanine residue (E293A).

In one embodiment, the Fc region is modified by substituting the tyrosine residue at position 296 with a phenylalanine residue (Y296F).

In one embodiment, the Fc region is modified by substituting the valine residue at position 303 with an alanine residue (V303A).

In one embodiment, the Fc region is modified by substituting the alanine residue at position 327 with a glycine residue (A327G).

In one embodiment, the Fc region is modified by substituting the lysine residue at position 338 with an alanine residue (K338A).

In one embodiment, the Fc region is modified by substituting the aspartic acid residue at position 376 with an alanine residue (D376A).

It will be appreciated that any of the modifications listed above can be combined to decrease FcγRIIIa binding.

Fc region variants with decreased FcR binding can be referred to as "FcγR ablation variants," "FcγR silencing variants" or "Fc knock out (FcKO or KO)" variants. For some therapeutic applications, it is desirable to reduce or remove the normal binding of an Fc domain to one or more or all of the Fcγ receptors (e.g., FcγR1, FcγRIIa, FcγRIIb, FcγRIIIa) to avoid additional mechanisms of action. That is, for example, in many embodiments, particularly in the use of MBMs that bind CD3 monovalently, it is generally desirable to ablate FcγRIIIa binding to eliminate or significantly reduce ADCC activity. In some embodiments, at least one of the Fc regions of the MBMs described herein comprises one or more Fcγ receptor ablation variants. In some embodiments, both of the Fc regions comprise one or more Fcγ receptor ablation variants. These ablation variants are depicted in Table 2, and each can be independently and optionally included or excluded, with some aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G E233P/L234V/L235A/G236del, D265A/N297A/P329A, D265N/N297D/P329G, and D265E/N297Q/P329S ("del" connotes a deletion, e.g., G236del refers to a deletion of the glycine at position 236). It should be noted that the ablation variants referenced herein ablate FcγR binding but generally not FcRn binding.

TABLE 2

| Ablation Variants | |
| --- | --- |
| Variant | Variant(s), cont. |
| G236R | P329K |
| S239G | A330L |
| S239K | A330S/P331S |

TABLE 2-continued

| | Ablation Variants |
| --- | --- |
| Variant | Variant(s), cont. |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | D265A/N297A/P329A |
| L328R | D265N/N297D/P329G |
| P329A | D265E/N297Q/P329S |
| P329H | |

In some embodiments, the MBMs of the present disclosure comprises a first Fc region and a second Fc region. In some embodiments, the first Fc region and/or the second Fc region can comprise the following mutations: E233P, L234V, L235A, G236del, and S267K.

The Fc domain of human IgG1 has the highest binding to the Fcγ receptors, and thus ablation variants can be used when the constant domain (or Fc domain) in the backbone of the heterodimeric antibody is IgG1.

Alternatively, or in addition to ablation variants in an IgG1 background, mutations at the glycosylation position 297, e.g., substituting the asparagine residue at position 297 with an alanine residue (N297A) or a glutamine residue (N297Q), can significantly ablate binding to FcγRIIIa, for example. Human IgG2 and IgG4 have naturally reduced binding to the Fcγ receptors, and thus those backbones can be used with or without the ablation variants.

7.3.1.2. Fc Domains with Altered Complement Binding

An MBM (e.g., TBM) can comprise an Fc domain in which one or both Fc regions comprises one or more modifications that alter Fc binding to complement. Altered complement binding can be increased binding or decreased binding.

In one embodiment, the Fc region comprises one or more modifications which decrease its binding to C1q. Initiation of the classical complement pathway starts with binding of hexameric C1q protein to the CH2 domain of antigen bound IgG and IgM.

In one embodiment, the MBM comprises an Fc domain in which one or both Fc regions comprises one or more modifications to decrease Fc binding to C1q.

In one embodiment, the Fc region is modified by substituting the leucine residue at position 234 with an alanine residue (L234A).

In one embodiment, the Fc region is modified by substituting the leucine residue at position 235 with an alanine residue (L235A).

In one embodiment, the Fc region is modified by substituting the leucine residue at position 235 with a glutamic acid residue (L235E).

In one embodiment, the Fc region is modified by substituting the glycine residue at position 237 with an alanine residue (G237A).

In one embodiment, the Fc region is modified by substituting the lysine residue at position 322 with an alanine residue (K322A).

In one embodiment, the Fc region is modified by substituting the proline residue at position 331 with an alanine residue (P331A).

In one embodiment, the Fc region is modified by substituting the proline residue at position 331 with a serine residue (P331S).

In one embodiment, a MBM comprises an Fc domain derived from IgG4. IgG4 has a naturally lower complement activation profile than IgG1, but also weaker binding of FcγR. Thus, in one embodiment, the MBM comprises an IgG4 Fc domain and also comprises one or more modifications that increase FcγR binding.

It will be appreciated that any of the modifications listed above can be combined to reduce C1q binding.

7.3.1.3. Fc Domains with Altered Disulfide Architecture

An MBM (e.g., TBM) can include an Fc domain comprising one or more modifications to create and/or remove a cysteine residue. Cysteine residues have an important role in the spontaneous assembly of Fc-based multispecific binding molecules, by forming disulfide bridges between individual pairs of polypeptide monomers. Thus, by altering the number and/or position of cysteine residues, it is possible to modify the structure of the MBM to produce a protein with improved therapeutic properties.

A MBM can comprise an Fc domain in which one or both Fc regions, e.g., both Fc regions, comprise a cysteine residue at position 309. In one embodiment, the cysteine residue at position 309 is created by a modification, e.g., for an Fc domain derived from IgG1, the leucine residue at position 309 is substituted with a cysteine residue (L309C), for an Fc domain derived from IgG2, the valine residue at position 309 is substituted with a cysteine residue (V309C).

In one embodiment, the Fc region is modified by substituting the valine residue at position 308 with a cysteine residue (V308C).

In one embodiment, two disulfide bonds in the hinge region are removed by mutating a core hinge sequence CPPC (SEQ ID NO: 2) to SPPS (SEQ ID NO: 3).

7.3.1.4. Fc Domains with Altered Glycosylation

In certain aspects, MBMs (e.g., TBMs) with improved manufacturability are provided that comprise fewer glycosylation sites than a corresponding immunoglobulin. These proteins have less complex post translational glycosylation patterns and are thus simpler and less expensive to manufacture.

In one embodiment, a glycosylation site in the CH2 domain is removed by substituting the asparagine residue at position 297 with an alanine residue (N297A) or a glutamine residue (N297Q). In addition to improved manufacturability, these aglycosyl mutants also reduce FcγR binding as described herein above.

In some embodiments, a MBM can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing a MBM in a host cell with altered glycosylation machinery. Cells with altered glycosylation machinery have been described in the art and can be used as host cells in which to express MBMs to thereby produce MBM with altered glycosylation. For example, EP 1,176,195 by Hang et al. describes a cell line with a functionally disrupted FUT8 gene, which encodes a fucosyl transferase, such that antibodies expressed in such a cell line exhibit hypofucosylation. PCT Publication WO3/035835 by Presta describes a variant CHO cell line, Lecl3 cells, with reduced ability to attach fucose to Asn(297)-linked carbohydrates, also resulting in hypofucosylation of antibodies expressed in that host cell (see also Shields et al., 2002, J. Biol. Chem. 277:26733-26740). PCT Publication WO 99/54342 by Umana et al. describes cell lines engineered to express glycoprotein-modifying glycosyl transferases (e.g., beta(1,4)-N acetylglucosaminyltransferase III (GnTIII)) such that antibodies expressed in the engineered cell lines exhibit increased bisecting GlcNac structures which results in increased ADCC activity of the antibodies (see also Umana et al., Nat. Biotech. 17:176-180, 1999).

7.3.1.5. Fc Heterodimerization

Many multispecific molecule formats entail dimerization between two Fc regions that, unlike a native immunoglobulin, are operably linked to non-identical antigen-binding domains (or portions thereof, e.g., a VH or VH-CH1 of a Fab). Inadequate heterodimerization of two Fc regions to form an Fc domain has always been an obstacle for increasing the yield of desired multispecific molecules and represents challenges for purification. A variety of approaches available in the art can be used in for enhancing dimerization of Fc regions that might be present in the MBMs (e.g., TBMs) of the disclosure, for example as disclosed in EP 1870459A1; U.S. Pat. Nos. 5,582,996, 5,731,168, 5,910,573, 5,932,448; 6,833,441; 7,183,076; U.S. Patent Application Publication No. 2006204493A1; and PCT Publication No. WO2009/089004A1.

The present disclosure provides MBMs (e.g., TBMs) comprising Fc heterodimers, i.e., Fc domains comprising heterologous, non-identical Fc regions. Heterodimerization strategies are used to enhance dimerization of Fc regions operably linked to different ABMs (or portions thereof, e.g., a VH or VH-CH1 of a Fab) and reduce dimerization of Fc regions operably linked to the same ABM or portion thereof. Typically, each Fc region in the Fc heterodimer comprises a CH3 domain of an antibody. The CH3 domains are derived from the constant region of an antibody of any isotype, class or subclass, and in some cases, of IgG (IgG1, IgG2, IgG3 and IgG4) class, as described in the preceding section.

Typically, the MBMs comprise other antibody fragments in addition to CH3 domains, such as, CH1 domains, CH2 domains, hinge domain, VH domain(s), VL domain(s), CDR(s), and/or antigen-binding fragments described herein. In some embodiments, the two hetero-polypeptides are two heavy chains forming a bispecific or multispecific molecules. Heterodimerization of the two different heavy chains at CH3 domains give rise to the desired antibody or antibody-like molecule, while homodimerization of identical heavy chains will reduce yield of the desired antibody or molecule. In an exemplary embodiment, the two or more hetero-polypeptide chains comprise two chains comprising CH3 domains and forming the molecules of any of the multispecific molecule formats described above of the present disclosure. In an embodiment, the two hetero-polypeptide chains comprising CH3 domains comprise modifications that favor heterodimeric association of the polypeptides, relative to unmodified chains. Various examples of modification strategies are provided below in Table 3 and Sections 7.3.1.5.1 to 7.3.1.5.7.

TABLE 3

| | Fc Heterodimerization Strategies | | | |
|---|---|---|---|---|
| NO. | STRATEGY | CH3 DOMAIN 1 | CH3 DOMAIN 2 | REFERENCES |
| Fc 1 | knobs-into-holes (Y-T) | T366Y | Y407T | Ridgway et al., 1996, Protein Eng 9:617-21 |
| Fc 2 | knobs-into-holes (CW-CSAV) | S354C, T366W | Y349C, T366S, L368A, Y407V | Atwell et al., 1997, J Mol Biol. 270(1):26-35; Merchant et al., 1998, Nat Biotechnol 16:677-681 |
| Fc 3 | HA-TF | S364H, F405A | Y349T, T394F | Moore et al., 2011, MAbs 3(6):546-57 |
| Fc 4 | ZW1 (VYAV-VLLW) | T350V, L351Y, F405A, Y407V | T350V, T366L, K392L, T394W | Von Kreudenstein et al., 2013, MAbs 5:646-54 |
| Fc 5 | CH3 charge pairs (DD-KK) | K392D, K409D | E356K, D399K | Gunasekaran et al., 2010, J Biol Chem 285:19637-46 |
| Fc 6 | IgG1 hingE,CH3 charge pairs (EEE-RRR) | IgG1: D221E, P228E, L368E | IgG1: D221R, P228R, K409R | Strop et al., 2012, J Mol Biol 420:204-19 |
| Fc 7 | IgG2 hingE,CH3 charge pairs (EEE-RRRR) | IgG2: C223E, P228E, L368E | IgG2: C223R, E225R, P228R, K409R | Strop et al., 2012, J Mol Biol 420:204-19 |
| Fc 8 | EW-RVT | K360E, K409W, | Q347R, D399V, F405T | Choi eta!., 2013, Mol Cancer Ther 12:2748-59 |
| Fc 9 | EW-RVTS-S | K360E, K409W, Y349C | Q347R, D399V, F405T, S354C | Choi eta!., 2015, Mol Immunol 65:377-83 |
| Fc 10 | Biclonic | 366K (+351K) | 351D or E or D at 349, 368, 349, or 349 + 355 | Geuijen et al., 2014, Journal of Clinical Oncology 32:suppl:560 |
| Fc 11 | DuoBody (L-R) | F405L | K409R | Labrijn et al., 2013, Proc Natl Acad Sci USA 110:5145-50 |
| Fc 12 | SEEDbody | IgG/A chimera | IgG/A chimera | Davis et al., 2010, Protein Eng Des Sel 23:195-202 |

TABLE 3-continued

| | | Fc Heterodimerization Strategies | | |
|---|---|---|---|---|
| NO. | STRATEGY | CH3 DOMAIN 1 | CH3 DOMAIN 2 | REFERENCES |
| Fc 13 | BEAT | residues from TCRα interface | residues from TCRβ interface | Moretti et al., 2013, BMC Proceedings 7(Suppl 6):09 |
| Fc 14 | 7.8.60 (DMA-RRW) | K360D, D399M, Y407A | E345R, Q347R, T366V, K409V | Lea ver-Fey et al., Structure 24:641-51 |
| Fc 15 | 20.8.34 (SYMV-GDQA) | Y349S, K370Y, T366M, K409V | E356G, E357D, S364Q, Y407A | Lea ver-Fey et al., Structure 24:641-51 |
| Fc 16 | Skew variant 12757 | None | none | Figure 34 of US 2016/0355600 |
| Fc 17 | Skew variant 12758 | L368D, K370S | S364K | Figure 34 of US 2016/0355600 |
| Fc 18 | Skew variant 12759 | L368D, K370S | S364K, E357L | Figure 34 of US 2016/0355600 |
| Fc 19 | Skew variant 12760 | L368D, K370S | S364K, E357Q | Figure 34 of US 2016/0355600 |
| Fc 20 | Skew variant 12761 | T411E, K360E, Q362E | D401K | Figure 34 of US 2016/0355600 |
| Fc 21 | Skew variant 12496 | L368E, K370S | S364K | Figure 34 of US 2016/0355600 |
| Fc 22 | Skew variant 12511 | K370S | S364K | Figure 34 of US 2016/0355600 |
| Fc 23 | Skew variant 12840 | L368E, K370S | S364K, E357Q | Figure 34 of US 2016/0355600 |
| Fc 24 | Skew variant 12841 | K370S | S364K, E357Q | Figure 34 of US 2016/0355600 |
| Fc 25 | Skew variant 12894 | L368E, K370S | S364K | Figure 34 of US 2016/0355600 |
| Fc 26 | Skew variant 12895 | K370S | S364K | Figure 34 of US 2016/0355600 |
| Fc 27 | Skew variant 12896 | L368E, K370S | S364K, E357Q | Figure 34 of US 2016/0355600 |
| Fc 28 | Skew variant 12901 | K370S | S364K, E357Q | FIG. 34 of US 2016/0355600 |
| Fc 29 | pl_ISO(-) | I199T, N203D, K274Q, R355Q, N384S, K392N, V397M, Q419E, DEL447 | | FIG. 31 of US 2016/0355600 |
| Fc 30 | pl_(-)_Isosteric_A | N208D, Q295E, N384D, Q418E, N421D | | FIG. 31 of US 2016/0355600 |
| Fc31 | pl_(-)_isosteric_B | N208D, Q295E, Q418E, N421D | | FIG. 31 of US 2016/0355600 |
| Fc 32 | pl_ISO(+RR) | Q196K, I199T, P217R, P228R, N276K | | FIG. 31 of US 2016/0355600 |
| Fc 33 | pl_ISO(+) | Q196K, I199T, N276K | | FIG. 31 of US 2016/0355600 |
| Fc 34 | pl_(+) isosteric_A | E269Q, E272Q, E283Q, E357Q, | | FIG. 31 of US 2016/0355600 |
| Fc 35 | pl_(+)_isosteric_B | E269Q, E272Q, E283Q | | FIG. 31 of US 2016/0355600 |
| Fc 36 | PL(+) isosteric_E269Q, E272Q | E269Q, E272Q | | FIG. 31 of US 2016/0355600 |
| Fc 37 | pl_(+)_isosteric_E269Q, E283Q | E269Q, E283Q | | FIG. 31 of US 2016/0355600 |
| Fc 38 | pl_(+) isosteric_E2720, E283Q | E272Q, E283Q | | FIG. 31 of US 2016/0355600 |
| Fc 39 | pl_(+)_isosteric_E269Q | E269Q | | FIG. 31 of US 2016/0355600 |
| Fc 40 | Heterodimerization | F405A | T394F | FIG. 30A of US 2016/0355600 |
| Fc 41 | Heterodimerization | S364D | Y349K | FIG. 30A of US 2016/0355600 |
| Fc 42 | Heterodimerization | S364E | L368K | FIG. 30A of US 2016/0355600 |
| Fc 43 | Heterodimerization | S364E | Y349K | FIG. 30A of US 2016/0355600 |
| Fc 44 | Heterodimerization | S364F | K370G | FIG. 30A of US 2016/0355600 |
| Fc 45 | Heterodimerization | S364H | Y349K | FIG. 30A of US 2016/0355600 |
| Fc 46 | Heterodimerization | S364H | Y349T | FIG. 30A of US 2016/0355600 |

TABLE 3-continued

| | Fc Heterodimerization Strategies | | | |
|---|---|---|---|---|
| NO. | STRATEGY | CH3 DOMAIN 1 | CH3 DOMAIN 2 | REFERENCES |
| Fc 47 | Heterodimerization | S364Y | K370G | FIG. 30A of US 2016/0355600 |
| Fc 48 | Heterodimerization | T411K | K370E | FIG. 30A of US 2016/0355600 |
| Fc 49 | Heterodimerization | V397S, F405A | T394F | FIG. 30A of US 2016/0355600 |
| Fc 50 | Heterodimerization | K370R, T411K | K370E, T411E | FIG. 30A of US 2016/0355600 |
| Fc 51 | Heterodimerization | L351E, S364D | Y349K, L351K | FIG. 30A of US 2016/0355600 |
| Fc 52 | Heterodimerization | L351E, S364E | Y349K, L351K | FIG. 30A of US 2016/0355600 |
| Fc 53 | Heterodimerization | L351E, T366D | L351K, T366K | FIG. 30A of US 2016/0355600 |
| Fc 54 | Heterodimerization | P395T,V397S, F405A | T394F | FIG. 30A of US 2016/0355600 |
| Fc 55 | Heterodimerization | S364D, K370G | S364Y, K370R | FIG. 30A of US 2016/0355600 |
| Fc 56 | Heterodimerization | S364D, T394F | Y349K, F405A | FIG. 30A of US 2016/0355600 |
| Fc 57 | Heterodimerization | S364E, F405A | Y349K, T394F | FIG. 30A of US 2016/0355600 |
| Fc 58 | Heterodimerization | S364E, F405S | Y349K, T394Y | FIG. 30A of US 2016/0355600 |
| Fc 59 | Heterodimerization | S364E, T411E | Y349K.D401K | FIG. 30A of US 2016/0355600 |
| Fc 60 | Heterodimerization | S364H.D401K | Y349T, T411E | FIG. 30A of US 2016/0355600 |
| Fc 61 | Heterodimerization | S364H, F405A | Y349T, T394F | FIG. 30A of US 2016/0355600 |
| Fc 62 | Heterodimerization | S364H, T394F | Y349T, F405A | FIG. 30A of US 2016/0355600 |
| Fc 63 | Heterodimerization | Y349C, S364E | Y349K, S354C | FIG. 30A of US 2016/0355600 |
| Fc 64 | Heterodimerization | L351E, S364D, F405A | Y349K, L351K, T394F | FIG. 30A of US 2016/0355600 |
| Fc 65 | Heterodimerization | L351K, S364H, D401K | Y349T, L351E, T411E | FIG. 30A of US 2016/0355600 |
| Fc 66 | Heterodimerization | S364E, T411E, F405A | Y349K, T394F, D401K | FIG. 30A of US 2016/0355600 |
| Fc 67 | Heterodimerization | S364H.D401K, F405A | Y349T, T394F, T411E | FIG. 30A of US 2016/0355600 |
| Fc 68 | Heterodimerization | S364H, F405A, T411E | Y349T, T394F, D401K | FIG. 30A of US 2016/0355600 |
| Fc 69 | Heterodimerization | T411E, K360E, N390D | D401K | FIG. 30C of US 2016/0355600 |
| Fc 70 | Heterodimerization | T411E, Q362E, N390D | D401K | FIG. 30C of US 2016/0355600 |
| Fc 71 | Heterodimerization | T411E, Q347R | D401K, K360D | FIG. 30C of US 2016/0355600 |
| Fc 72 | Heterodimerization | T411E, Q347R | D401K, K360E | FIG. 30C of US 2016/0355600 |
| Fc 73 | Heterodimerization | T411E, K360 | D401K, Q347K | FIG. 30C of US 2016/0355600 |
| Fc 74 | Heterodimerization | T411E, K360D | D401K, Q347R | FIG. 30C of US 2016/0355600 |
| Fc 75 | Heterodimerization | T411E, K360E | D401K, Q347K | FIG. 30C of US 2016/0355600 |
| Fc 76 | Heterodimerization | T411E, K360E | D401K, Q347R | FIG. 30C of US 2016/0355600 |
| Fc 77 | Heterodimerization | T411E, S364K | D401K, K370S | FIG. 30C of US 2016/0355600 |
| Fc 78 | Heterodimerization | T411E, K370S | D401K, S364K | FIG. 30C of US 2016/0355600 |
| Fc 79 | Heterodimerization | Q347E | E357Q | FIG. 30C of US 2016/0355600 |
| Fc 80 | Heterodimerization | Q347E | E357Q, Q362K | FIG. 30C of US 2016/0355600 |
| Fc 81 | Heterodimerization | K360D, Q362E | Q347R | FIG. 30C of US 2016/0355600 |
| Fc 82 | Heterodimerization | K360D, Q362E | D401K | FIG. 30C of US 2016/0355600 |
| Fc 83 | Heterodimerization | K360D, Q362E | Q347R, D401K | FIG. 30C of US 2016/0355600 |
| Fc 84 | Heterodimerization | K360E, Q362E | Q347R | FIG. 30C of US 2016/0355600 |

TABLE 3-continued

| | | Fc Heterodimerization Strategies | | |
|---|---|---|---|---|
| NO. | STRATEGY | CH3 DOMAIN 1 | CH3 DOMAIN 2 | REFERENCES |
| Fc 85 | Heterodimerization | K360E, Q362E | D401K | FIG. 30C of US 2016/0355600 |
| Fc 86 | Heterodimerization | K360E, Q362E | Q347R, D401K | FIG. 30C of US 2016/0355600 |
| Fc 87 | Heterodimerization | Q362E, N390D | D401K | FIG. 30C of US 2016/0355600 |
| Fc 88 | Heterodimerization | Q347E, K360D | D401N | FIG. 30C of US 2016/0355600 |
| Fc 89 | Heterodimerization | K360D | Q347R, N390K | FIG. 30C of US 2016/0355600 |
| Fc 90 | Heterodimerization | K360D | N390K, D401N | FIG. 30C of US 2016/0355600 |
| Fc 91 | Heterodimerization | K360E | Y349H | FIG. 30C of US 2016/0355600 |
| Fc 92 | Heterodimerization | K370S, Q347E | S364K | FIG. 30C of US 2016/0355600 |
| Fc 93 | Heterodimerization | K370S, E357L | S364K | FIG. 30C of US 2016/0355600 |
| Fc 94 | Heterodimerization | K370S, E357Q | S364K | FIG. 30C of US 2016/0355600 |
| Fc 95 | Heterodimerization | K370S, Q347E, E357L | S364K | FIG. 30C of US 2016/0355600 |
| Fc 96 | Heterodimerization | K370S, Q347E, E357Q | S364K | FIG. 30C of US 2016/0355600 |
| Fc 97 | Heterodimerization | L368D, K370S, Q347E | S364K | FIG. 30D of US 2016/0355600 |
| Fc 98 | Heterodimerization | L368D, K370S, E357L | S364K | FIG. 30D of US 2016/0355600 |
| Fc 99 | Heterodimerization | L368D, K370S, E357Q | S364K | FIG. 30D of US 2016/0355600 |
| Fc 100 | Heterodimerization | L368D, K370S, Q347E, E357L | S364K | FIG. 30D of US 2016/0355600 |
| Fc 101 | Heterodimerization | L368D, K370S, Q347E, E357Q | S364K | FIG. 30D of US 2016/0355600 |
| Fc 102 | Heterodimerization | L368E, K370S, Q347E | S364K | FIG. 30D of US 2016/0355600 |
| Fc 103 | Heterodimerization | L368E, K370S, E357L | S364K | FIG. 30D of US 2016/0355600 |
| Fc 104 | Heterodimerization | L368E, K370S, E357Q | S364K | FIG. 30D of US 2016/0355600 |
| Fc 105 | Heterodimerization | L368E, K370S, Q347E, E357L | S364K | FIG. 30D of US 2016/0355600 |
| Fc 106 | Heterodimerization | L368E, K370S, Q347E, E357Q | S364K | FIG. 30D of US 2016/0355600 |
| Fc 107 | Heterodimerization | L368D, K370T, Q347E | S364K | FIG. 30D of US 2016/0355600 |
| Fc 108 | Heterodimerization | L368D, K370T, E357L | S364K | FIG. 30D of US 2016/0355600 |
| Fc 109 | Heterodimerization | L368D, K370T, E357Q | S364K | FIG. 30D of US 2016/0355600 |
| Fc 110 | Heterodimerization | L368D, K370T, Q347E, E357L | S364K | FIG. 30D of US 2016/0355600 |
| Fc 111 | Heterodimerization | L368D, K370T, Q347E, E357Q | S364K | FIG. 30D of US 2016/0355600 |
| Fc 112 | Heterodimerization | L368E, K370T, Q347E | S364K | FIG. 30D of US 2016/0355600 |
| Fc 113 | Heterodimerization | L368E, K370T, E357L | S364K | FIG. 30D of US 2016/0355600 |
| Fc 114 | Heterodimerization | L368E, K370T, E357Q | S364K | FIG. 30D of US 2016/0355600 |
| Fc 115 | Heterodimerization | L368E, K370T, Q347E, E357L | S364K | FIG. 30D of US 2016/0355600 |
| Fc 116 | Heterodimerization | L368E, K370T, Q347E, E357Q | S364K | FIG. 30D of US 2016/0355600 |
| Fc 117 | Heterodimerization | T411E, Q362E | D401K, T411K | FIG. 30D of US 2016/0355600 |
| Fc 118 | Heterodimerization | T411E, N390D | D401K, T411K | FIG. 30D of US 2016/0355600 |
| Fc 119 | Heterodimerization | T411E, Q362E | D401R, T411R | FIG. 30D of US 2016/0355600 |
| Fc 120 | Heterodimerization | T411E, N390D | D401R, T411R | FIG. 30D of US 2016/0355600 |
| Fc 121 | Heterodimerization | Y407T | T366Y | FIG. 30D of US 2016/0355600 |
| Fc 122 | Heterodimerization | F405A | T394W | FIG. 30D of US 2016/0355600 |

TABLE 3-continued

| | | Fc Heterodimerization Strategies | | |
|---|---|---|---|---|
| NO. | STRATEGY | CH3 DOMAIN 1 | CH3 DOMAIN 2 | REFERENCES |
| Fc 123 | Heterodimerization | T366Y, F405A | T394W, Y407T | FIG. 30D of US 2016/0355600 |
| Fc 124 | Heterodimerization | T366S, L368A, Y407V | T366W | FIG. 30D of US 2016/0355600 |
| Fc 125 | Heterodimerization | T366S, L368A, Y407V, Y349C | T366W, S354C | FIG. 30D of US 2016/0355600 |
| Fc 126 | Heterodimerization | K392D, K409D | E356K.D399K | FIG. 30E of US 2016/0355600 |
| Fc 127 | Heterodimerization | K370D, K392D, K409D | E356K, E357K, D399K | FIG. 30E of US 2016/0355600 |
| Fc 128 | Heterodimerization | I199T, N203D, K247Q,R355Q, N384S, K392N, V397M, Q419E, K447 | Q196K, L99T, P217R, P228R, N276K | FIG. 30E of US 2016/0355600 |
| Fc 129 | Heterodimerization | I199T, N203D, K247Q,R355Q, N384S, K392N, V397M, Q419E, K447 | Q196K, L99T, N276K | FIG. 30E of US 2016/0355600 |
| Fc 130 | Heterodimerization | N384S, K392N, V397M, Q419E | N276K | FIG. 30E of US 2016/0355600 |
| Fc 131 | Heterodimerization | D221E, P228E, L368E | D221R, P228R, K409R | FIG. 30E of US 2016/0355600 |
| Fc 132 | Heterodimerization | C220E, P228E, L368E | C220R, E224R, P228R, K409R | FIG. 30E of US 2016/0355600 |
| Fc 133 | Heterodimerization | F405L | K409R | FIG. 30E of US 2016/0355600 |
| Fc 134 | Heterodimerization | T366I, K392M, T394W | F405A, Y407V | FIG. 30E of US 2016/0355600 |
| Fc 135 | Heterodimerization | T366V, K409F | L351Y, Y407A | FIG. 30E of US 2016/0355600 |
| Fc 136 | Heterodimerization | T366A, K392E, K409F, T411E | D399R, S400R, Y407A | FIG. 30E of US 2016/0355600 |
| Fc 137 | Heterodimerization | L351K | L351E | FIG. 30E of US 2016/0355600 |
| Fc 138 | Heterodimerization | H99T, N203D, K247Q,R355Q, Q419E, K447 | Q196K, L199T, P217R, P228R, N276K | FIG. 30E of US 2016/0355600 |
| Fc 139 | Heterodimerization | I199T, N203D, K247Q,R355Q, Q419E, K447 | Q196K, I199T, N276K | FIG. 30E of US 2016/0355600 |
| Fc 140 | Heterodimerization | I199T, N203D, K274Q, R355Q, N384S, K392N, V397M, Q419E DEL447 | | FIG. 30E of US 2016/0355600 |
| Fc 141 | Heterodimerization | N208D, Q295E N384D, Q418E N421D | | FIG. 30E of US 2016/0355600 |
| Fc 142 | Heterodimerization | N208D, Q295E Q418E, N421D | | FIG. 30E of US 2016/0355600 |
| Fc 143 | Heterodimerization | Q196K, I199T P217R, P228R N276K | | FIG. 30E of US 2016/0355600 |
| Fc 144 | Heterodimerization | Q196K, I199T N276K | | FIG. 30E of US 2016/0355600 |
| Fc 145 | Heterodimerization | E269Q, E272Q E283Q, E357Q | | FIG. 30E of US 2016/0355600 |
| Fc 146 | Heterodimerization | E269Q, E272Q E283Q, | | FIG. 30E of US 2016/0355600 |
| Fc 147 | Heterodimerization | E269Q, E272Q | | FIG. 30E of US 2016/0355600 |
| Fc 148 | Heterodimerization | E269Q, E283Q | | FIG. 30E of US 2016/0355600 |
| Fc 149 | Heterodimerization | E272Q, E283Q | | FIG. 30E of US 2016/0355600 |
| Fc 150 | Heterodimerization | E269Q | | FIG. 30E of US 2016/0355600 |

Exemplary pairs of heterologous, non-identical Fc sequences that can pair to form a Fc heterodimer, and which can be included in MBM of the disclosure, include (i) SEQ ID NO:869 and SEQ ID NO:870, and (ii) SEQ ID NO:869 and SEQ ID NO:871.

```
                                       (SEQ ID NO: 869)
DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKE

YKCKVSNKALPAPIEKTISKAKGQPREPQVCTLPPSREEMTKNQVSLSC

AVKGFYPSDIAVEWESNGQPENNYKTTPPVLDSDGSFFLVSKLTVDKSR

WQQGNVFSCSVMHEALHNHYTQKSLSLSPGK
```

```
                                       (SEQ ID NO: 870)
DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKE

YKCKVSNKALPAPIEKTISKAKGQPREPQVYTLPPCREEMTKNQVSLWC

LVKGFYPSDIAVEWESNGQPENNYKTTPPVLDSDGSFFLYSKLTVDKSR

WQQGNVFSCSVMHEALHNHYTQKSLSLSPGK
```

```
                                       (SEQ ID NO: 871)
DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKE

YKCKVSNKALPAPIEKTISKAKGQPREPQVYTLPPCREEMTKNQVSLWC

LVKGFYPSDIAVEWESNGQPENNYKTTPPVLDSDGSFFLYSKLTVDKSR

WQQGNVFSCSVMHEALHNRYTQKSLSLSPGK
```

An Fc region having an amino acid sequence of one of SEQ ID NOS: 869-871 can be modified to include one or more of the substitutions described in Section 7.3.1 (including its subparts), for example to include the substitution(s) corresponding to an ablation variant set forth in Table 3. In some embodiments, a MBM comprises an Fc region having an amino acid sequence of one of SEQ ID NOs:869-871 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 (EU numbering), for example mutation(s) described in Section 7.3.1 (including its subparts). For example, a MBM can comprise an Fc region having an amino acid sequence of SEQ ID NO:869 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 and/or an Fc region having an amino acid sequence of SEQ ID NO:870 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 and/or an Fc region having an amino acid sequence of SEQ ID NO:871 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332.

7.3.1.5.1. Steric Variants

MBMs (e.g., TBMs) can comprise one or more, e.g., a plurality, of modifications to one or more of the constant domains of an Fc domain, e.g., to the CH3 domains. In one example, a MBM (e.g., a TBM) comprises two polypeptides that each comprise a heavy chain constant domain of an antibody, e.g., a CH2 or CH3 domain. In an example, the two heavy chain constant domains, e.g., the CH2 or CH3 domains of the MBM (e.g., TBM) comprise one or more modifications that allow for a heterodimeric association between the two chains. In one aspect, the one or more modifications are disposed on CH2 domains of the two heavy chains. In one aspect, the one or more modifications are disposed on CH3 domains of at least two polypeptides of the MBM.

One mechanism for Fc heterodimerization is generally referred to in the art as "knobs and holes", or "knob-in-holes", or "knobs-into-holes". These terms refer to amino acid mutations that create steric influences to favor formation of Fc heterodimers over Fc homodimers, as described in, e.g., Ridgway et al., 1996, Protein Engineering 9(7):617; Atwell et al., 1997, J. Mol. Biol. 270:26; U.S. Pat. No. 8,216,805. Knob-in-hole mutations can be combined with other strategies to improve heterodimerization.

In one aspect, the one or more modifications to a first polypeptide of the MBM comprising a heavy chain constant domain can create a "knob" and the one or more modifications to a second polypeptide of the MBM creates a "hole," such that heterodimerization of the polypeptide of the MBM comprising a heavy chain constant domain causes the "knob" to interface (e.g., interact, e.g., a CH2 domain of a first polypeptide interacting with a CH2 domain of a second polypeptide, or a CH3 domain of a first polypeptide interacting with a CH3 domain of a second polypeptide) with the "hole." The "knob" projects from the interface of a first polypeptide of the MBM comprising a heavy chain constant domain and is therefore positionable in a compensatory "hole" in the interface with a second polypeptide of the MBM comprising a heavy chain constant domain so as to stabilize the heteromultimer, and thereby favor heteromultimer formation over homomultimer formation, for example. The knob can exist in the original interface or can be introduced synthetically (e.g. by altering nucleic acid encoding the interface). The import residues for the formation of a knob are generally naturally occurring amino acid residues and can be selected from arginine (R), phenylalanine (F), tyrosine (Y) and tryptophan (W). In some cases, tryptophan and tyrosine are selected. In an embodiment, the original residue for the formation of the protuberance has a small side chain volume, such as alanine, asparagine, aspartic acid, glycine, serine, threonine or valine.

A "hole" comprises at least one amino acid side chain which is recessed from the interface of a second polypeptide of the MBM comprising a heavy chain constant domain and therefore accommodates a corresponding knob on the adjacent interfacing surface of a first polypeptide of the MBM comprising a heavy chain constant domain. The hole can exist in the original interface or can be introduced synthetically (e.g. by altering nucleic acid encoding the interface). The import residues for the formation of a hole are usually naturally occurring amino acid residues and are in some embodiments selected from alanine (A), serine (S), threonine (T) and valine (V). In one embodiment, the amino acid residue is serine, alanine or threonine. In another embodiment, the original residue for the formation of the hole has a large side chain volume, such as tyrosine, arginine, phenylalanine or tryptophan.

In an embodiment, a first CH3 domain is modified at residue 366, 405 or 407 to create either a "knob" or a hole" (as described above), and the second CH3 domain that heterodimerizes with the first CH3 domain is modified at: residue 407 if residue 366 is modified in the first CH3 domain, residue 394 if residue 405 is modified in the first CH3 domain, or residue 366 if residue 407 is modified in the first CH3 domain to create a "hole" or "knob" complementary to the "knob" or "hole" of the first CH3 domain.

In another embodiment, a first CH3 domain is modified at residue 366, and the second CH3 domain that heterodimerizes with the first CH3 domain is modified at residues 366, 368 and/or 407, to create a "hole" or "knob" complementary to the "knob" or "hole" of the first CH3 domain. In one embodiment, the modification to the first CH3 domain introduces a tyrosine (Y) residue at position 366. In an embodiment, the modification to the first CH3 is T366Y. In one embodiment, the modification to the first CH3 domain introduces a tryptophan (W) residue at position 366. In an embodiment, the modification to the first CH3 is T366W. In some embodiments, the modification to the second CH3 domain that heterodimerizes with the first CH3 domain modified at position 366 (e.g., has a tyrosine (Y) or tryptophan (W) introduced at position 366, e.g., comprises the modification T366Y or T366W), comprises a modification at position 366, a modification at position 368 and a modification at position 407. In some embodiments, the modification at position 366 introduces a serine (S) residue, the modification at position 368 introduces an alanine (A), and the modification at position 407 introduces a valine (V). In some embodiments, the modifications comprise T366S, L368A and Y407V. In one embodiment, the first CH3 domain of the multispecific molecule comprises the modification T366Y, and the second CH3 domain that heterodimerizes with the first CH3 domain comprises the modifications T366S, L368A and Y407V, or vice versa. In one embodiment, the first CH3 domain of the multispecific molecule comprises the modification T366W, and the second CH3 domain that heterodimerizes with the first CH3 domain comprises the modifications T366S, L368A and Y407V, or vice versa.

Additional steric or "skew" (e.g., knob-in-hole) modifications are described in PCT publication no. WO2014/145806 (for example, FIG. 3, FIG. 4 and FIG. 12 of WO2014/145806), PCT publication no. WO2014/110601, and PCT publication no. WO 2016/086186, WO 2016/086189, WO 2016/086196 and WO 2016/182751. An example of a KIH variant comprises a first constant chain comprising a L368D and a K370S modification, paired with a second constant chain comprising a S364K and E357Q modification.

Additional knob-in-hole modification pairs suitable for use in any of the MBMs of the present disclosure are further described in, for example, WO1996/027011, and Merchant et al., 1998, Nat. Biotechnol., 16:677-681.

In further embodiments, the CH3 domains can be additionally modified to introduce a pair of cysteine residues. Without being bound by theory, it is believed that the introduction of a pair of cysteine residues capable of forming a disulfide bond provide stability to heterodimerized MBMs (e.g., TBMs) comprising paired CH3 domains. In some embodiments, the first CH3 domain comprises a cysteine at position 354, and the second CH3 domain that heterodimerizes with the first CH3 domain comprises a cysteine at position 349. In some embodiments, the first CH3 domain comprises a cysteine at position 354 (e.g., comprises the modification S354C) and a tyrosine (Y) at position 366 (e.g., comprises the modification T366Y), and the second CH3 domain that heterodimerizes with the first CH3 domain comprises a cysteine at position 349 (e.g., comprises the modification Y349C), a serine at position 366 (e.g., comprises the modification T366S), an alanine at position 368 (e.g., comprises the modification L368A), and a valine at position 407 (e.g., comprises the modification Y407V). In some embodiments, the first CH3 domain comprises a cysteine at position 354 (e.g., comprises the modification S354C) and a tryptophan (VV) at position 366 (e.g., comprises the modification T366W), and the second CH3 domain that heterodimerizes with the first CH3 domain comprises a cysteine at position 349 (e.g., comprises the modification Y349C), a serine at position 366 (e.g., comprises the modification T366S), an alanine at position 368 (e.g., comprises the modification L368A), and a valine at position 407 (e.g., comprises the modification Y407V).

An additional mechanism that finds use in the generation of heterodimers is sometimes referred to as "electrostatic steering" as described in Gunasekaran et al., 2010, J. Biol. Chem. 285(25):19637. This is sometimes referred to herein as "charge pairs". In this embodiment, electrostatics are used to skew the formation towards heterodimerization. These can also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R and C220E/P228E, 368E paired with C220R/E224R/P228R/K409R.

Additional variants that can be combined with other variants, optionally and independently in any amount, such as pI variants outlined herein or other steric variants that are shown in FIG. 37 of US 2012/0149876.

In some embodiments, the steric variants outlined herein can be optionally and independently incorporated with any pI variant (or other variants such as Fc variants, FcRn variants) into one or both Fc regions, and can be independently and optionally included or excluded from the MBMs of the disclosure.

A list of suitable skew variants is found in Table 4 showing some pairs of particular utility in many embodiments. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L; and K370S:S364K/E357Q. In terms of nomenclature, the pair "S364K/E357Q:L368D/K370S" means that one of the Fc regions has the double variant set S364K/E357Q and the other has the double variant set L368D/K370S.

TABLE 4

| Exemplary skew variants | |
| --- | --- |
| Fc region 1 | Fc region 2 |
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |

TABLE 4-continued

| Exemplary skew variants | |
| --- | --- |
| Fc region 1 | Fc region 2 |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |
| K392D/K409D | E356K/D399K |
| K370D/K392D/K409D | E356K/E357K/D399K |
| I199T/N203D/K247Q/R355Q/N384S/ K392N/V397M/Q419E/K447_ | Q196K/I199T/P217R/ P228R/N276K |
| I199T/N203D/K247Q/R355Q/N384S/ K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/ K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/ P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |

TABLE 4-continued

| Exemplary skew variants | |
| --- | --- |
| Fc region 1 | Fc region 2 |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/ K392N/V397M/Q419E/K447_ | Q196K/I199T/P217R/ P228R/N276K |
| I199T/N203D/K247Q/R355Q/N384S/ K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/ K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/ P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295EQ418E N421D | |
| Q196K I199T P217R P228R N276K | |
| Q196K I199T N276K | |
| E269Q E272Q E283Q E357Q | |

TABLE 4-continued

Exemplary skew variants

| Fc region 1 | Fc region 2 |
| --- | --- |
| E269Q E272Q E283Q | |
| E269Q E272Q | |
| E269Q E283Q | |
| E272Q E283Q | |
| E269Q | |

In some embodiments, a MBM comprises a first Fc region and a second Fc region. In some embodiments, the first Fc region comprises the following mutations: L368D and K370S, and the second Fc region comprises the following mutations: S364K and E357Q. In some embodiments, the pI of the protein (basic changes) and those that decrease the pI of the protein (acidic changes). As described herein, all combinations of these variants can be done: one Fc region can be wild type, or a variant that does not display a significantly different pI from wild-type, and the other can be either more basic or more acidic. Alternatively, each Fc region is changed, one to more basic and one to more acidic.

Exemplary combinations of pI variants are shown in Table 5. As outlined herein and shown in Table 5, these changes are shown relative to IgG1, but all isotypes can be altered this way, as well as isotype hybrids. In the case where the heavy chain constant domain is from IgG2-4, R133E and R133Q can also be used.

TABLE 5

Exemplary pI Variant Combinations

| Variant constant region | Substitutions |
| --- | --- |
| pI_ISO(−) | I199T N203D K274Q R355Q N384S K392N V397M Q419E DEL447 |
| pI_(−)_isosteric_A | N208D Q295E N384D Q418E N421D |
| pI_(−)_isosteric A-Fc only | Q295E N384D Q418E N421D |
| pI_(−)_isosteric_B | N208D Q295E Q418E N421D |
| pI_(−)_isosteric_B-Fc only | Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q | first Fc region comprises the following mutations: S364K and E357Q, and the second Fc region comprises the following mutations: L368D and K370S.

7.3.1.5.2. Alternative Knob and Hole: IgG Heterodimerization

Heterodimerization of polypeptide chains of a MBM (e.g., a TBM) comprising paired CH3 domains can be increased by introducing one or more modifications in a CH3 domain which is derived from the IgG1 antibody class. In an embodiment, the modifications comprise a K409R modification to one CH3 domain paired with F405L modification in the second CH3 domain. Additional modifications can also, or alternatively, be at positions 366, 368, 370, 399, 405, 407, and 409. In some cases, heterodimerization of polypeptides comprising such modifications is achieved under reducing conditions, e.g., 10-100 mM 2-MEA (e.g., 25, 50, or 100 mM 2-MEA) for 1-10, e.g., 1.5-5, e.g., 5, hours at 25-37 C, e.g., 25 C or 37 C.

The amino acid replacements described herein can be introduced into the CH3 domains using techniques which are well known (see, e.g., McPherson, ed., 1991, Directed Mutagenesis: a Practical Approach; Adelman et al., 1983, DNA, 2:183).

The IgG heterodimerization strategy is further described in, for example, WO2008/119353, WO2011/131746, and WO2013/060867.

In any of the embodiments described in this Section, the CH3 domains can be additionally modified to introduce a pair of cysteine residues as described in Section 7.3.1.3.

7.3.1.5.3. pI (Isoelectric Point) Variants

In general, as a skilled artisan will appreciate, there are two general categories of pI variants: those that increase the In one embodiment, a combination of pI variants has one Fc region (the negative Fab side) comprising 208D, 295E, 384D, 418E, 421D variants (N208D/Q295E/N384D/Q418E/N421D when relative to human IgG1) and a second Fc region (the positive scFv side) comprising a positively charged scFv linker, e.g., L36 (described in Section 7.3.3). However, as a skilled artisan will appreciate, the first Fc region includes a CH1 domain, including position 208. Accordingly, in constructs that do not include a CH1 domain (for example for MBMs that do not utilize a CH1 domain as one of the domains, for example in a format depicted in FIG. 1K), a negative pI variant Fc set can include 295E, 384D, 418E, 421D variants (Q295E/N384D/Q418E/N421D when relative to human IgG1).

In some embodiments, a first Fc region has a set of substitutions from Table 5 and a second Fc region is connected to a charged linker (e.g., selected from those described in Section 7.3.3).

In some embodiments, a MBM comprises a first Fc region and a second Fc region. In some embodiments, the first Fc region comprises the following mutations: N208D, Q295E, N384D, Q418E, and N421D. In some embodiments, the second Fc region comprises the following mutations: N208D, Q295E, N384D, Q418E, and N421D.

7.3.1.5.4. Isotopic Variants

In addition, many embodiments of the disclosure rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting Fc region is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, as is further described below.

In addition, by pI engineering both the heavy and light constant domains of a MBM comprising two half antibodies, significant changes in each half antibody can be seen. Having the pIs of the two half antibodies differ by at least 0.5 can allow separation by ion exchange chromatography or isoelectric focusing, or other methods sensitive to isoelectric point.

7.3.1.5.5. Calculating pI

The pI of a half antibody comprising an Fc region and a ABD or ABD chain can depend on the pI of the variant heavy chain constant domain and the pI of the total half antibody, including the variant heavy chain constant domain and ABD or ABD chain. Thus, in some embodiments, the change in pI is calculated on the basis of the variant heavy chain constant domain, using the chart in the FIG. 19 of US Pub. 2014/0370013. As discussed herein, which half antibody to engineer is generally decided by the inherent pI of the half antibodies. Alternatively, the pI of each half antibody can be compared.

7.3.1.5.6. pI Variants that also Confer Better FcRn In Vivo Binding

In the case where a pI variant decreases the pI of an Fc region, it can have the added benefit of improving serum retention in vivo.

pI variant Fc regions are believed to provide longer half-lives to antigen binding molecules in vivo, because binding to FcRn at pH 6 in an endosome sequesters the Fc (Ghetie and Ward, 1997, Immunol Today. 18(12): 592-598). The endosomal compartment then recycles the Fc to the cell surface. Once the compartment opens to the extracellular space, the higher pH ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dall' Acqua et al., 2002, J. Immunol. 169:5171-5180). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

It has been suggested that antibodies with variable regions that have lower isoelectric points can also have longer serum half-lives (Igawa et al., 2010, PEDS. 23(5): 385-392). However, the mechanism of this is still poorly understood. Moreover, variable regions differ from antibody to antibody. Constant region variants with reduced pI and extended half-life would provide a more modular approach to improving the pharmacokinetic properties of MBMs, as described herein.

7.3.1.5.7. Polar Bridge

Heterodimerization of polypeptide chains of MBMs (e.g., TBMs) comprising an Fc domain can be increased by introducing modifications based on the "polar-bridging" rationale, which is to make residues at the binding interface of the two polypeptide chains to interact with residues of similar (or complimentary) physical property in the heterodimer configuration, while with residues of different physical property in the homodimer configuration. In particular, these modifications are designed so that, in the heterodimer formation, polar residues interact with polar residues, while hydrophobic residues interact with hydrophobic residues. In contrast, in the homodimer formation, residues are modified so that polar residues interact with hydrophobic residues. The favorable interactions in the heterodimer configuration and the unfavorable interactions in the homodimer configuration work together to make it more likely for Fc regions to form heterodimers than to form homodimers.

In an exemplary embodiment, the above modifications are generated at one or more positions of residues 364, 368, 399, 405, 409, and 411 of a CH3 domain.

In some embodiments, one or more modifications selected from the group consisting of S364L, T366V, L368Q, N399K, F405S, K409F and R411K are introduced into one of the two CH3 domains. One or more modifications selected from the group consisting of Y407F, K409Q and T411N can be introduced into the second CH3 domain.

In another embodiment, one or more modifications selected from the group consisting of S364L, T366V, L368Q, D399K, F405S, K409F and T411K are introduced into one CH3 domain, while one or more modifications selected from the group consisting of Y407F, K409Q and T411D are introduced into the second CH3 domain.

In one exemplary embodiment, the original residue of threonine at position 366 of one CH3 domain is replaced by valine, while the original residue of tyrosine at position 407 of the other CH3 domain is replaced by phenylalanine.

In another exemplary embodiment, the original residue of serine at position 364 of one CH3 domain is replaced by leucine, while the original residue of leucine at position 368 of the same CH3 domain is replaced by glutamine.

In yet another exemplary embodiment, the original residue of phenylalanine at position 405 of one CH3 domain is replaced by serine and the original residue of lysine at position 409 of this CH3 domain is replaced by phenylalanine, while the original residue of lysine at position 409 of the other CH3 domain is replaced by glutamine.

In yet another exemplary embodiment, the original residue of aspartic acid at position 399 of one CH3 domain is replaced by lysine, and the original residue of threonine at position 411 of the same CH3 domain is replaced by lysine, while the original residue of threonine at position 411 of the other CH3 domain is replaced by aspartic acid.

The amino acid replacements described herein can be introduced into the CH3 domains using techniques which are well known (see, e.g., McPherson, ed., 1991, Directed Mutagenesis: a Practical Approach; Adelman et al., 1983, DNA, 2:183). The polar bridge strategy is described in, for example, WO2006/106905, WO2009/089004 and K. Gunasekaran, et al. (2010) JBC, 285:19637-19646.

Additional polar bridge modifications are described in, for example, PCT publication no. WO2014/145806 (for example, FIG. 6 of WO2014/145806), PCT publication no.

WO2014/110601, and PCT publication no. WO 2016/086186, WO 2016/086189, WO 2016/086196 and WO 2016/182751. An example of a polar bridge variant comprises a constant chain comprising a N208D, Q295E, N384D, Q418E and N421D modification.

In any of the embodiments described herein, the CH3 domains can be additionally modified to introduce a pair of cysteine residues as described in Section 7.3.1.3.

Additional strategies for enhancing heterodimerization are described in, for example, WO2016/105450, WO2016/086186, WO2016/086189, WO2016/086196, WO2016/141378, and WO2014/145806, and WO2014/110601. Any of the strategies can be employed in a MBM described herein.

7.3.1.6. Combination of Heterodimerization Variants and Other Fc Variants

As will be appreciated by a skilled artisan, all of the recited heterodimerization variants (including skew and/or pI variants) can be optionally and independently combined in any way, as long as the Fc regions of an Fc domain retain their ability to dimerize. In addition, all of these variants can be combined into any of the heterodimerization formats.

In the case of pI variants, while embodiments finding particular use are shown in the Table 5, other combinations can be generated, following the basic rule of altering the pI difference between two Fc regions in an Fc heterodimer to facilitate purification.

In addition, any of the heterodimerization variants, skew and pI, are also independently and optionally combined with Fc ablation variants, Fc variants, FcRn variants, as generally outlined herein.

In some embodiments, a particular combination of skew and pI variants that finds use in the present disclosure is T366S/L368A/Y407V:T366W (optionally including a bridging disulfide, T366S/L368A/Y407V/Y349C:T366W/S354C) with one Fc region comprising Q295E/N384D/Q418E/N481D and the other a positively charged scFv linker (when the format includes an scFv domain). As will be appreciated by a skilled artisan, the "knobs in holes" variants do not change pI, and thus can be used on either one of the Fc regions in an Fc heterodimer.

In some embodiments, first and second Fc regions that find use the present disclosure include the amino acid substitutions S364K/E357Q:L368D/K370S, where the first and/or second Fc region includes the ablation variant substitutions 233P/L234V/L235A/G236del/S267K, and the first and/or second Fc region comprises the pI variant substitutions N208D/Q295E/N384D/Q418E/N421D (pI_(−)_isosteric_A).

7.3.2. Hinge Regions

The MBMs (e.g., TBMs) can also comprise hinge regions, e.g., connecting an antigen-binding module to an Fc region. The hinge region can be a native or a modified hinge region. Hinge regions are typically found at the N-termini of Fc regions.

A native hinge region is the hinge region that would normally be found between Fab and Fc domains in a naturally occurring antibody. A modified hinge region is any hinge that differs in length and/or composition from the native hinge region. Such hinges can include hinge regions from other species, such as human, mouse, rat, rabbit, shark, pig, hamster, camel, llama or goat hinge regions. Other modified hinge regions can comprise a complete hinge region derived from an antibody of a different class or subclass from that of the heavy chain Fc region. Alternatively, the modified hinge region can comprise part of a natural hinge or a repeating unit in which each unit in the repeat is derived from a natural hinge region. In a further alternative, the natural hinge region can be altered by converting one or more cysteine or other residues into neutral residues, such as serine or alanine, or by converting suitably placed residues into cysteine residues. By such means the number of cysteine residues in the hinge region can be increased or decreased. This approach is described further in U.S. Pat. No. 5,677,425 by Bodmer et al. Altering the number of cysteine residues in a hinge region can, for example, facilitate assembly of light and heavy chains, or increase or decrease the stability of a MBM. Other modified hinge regions can be entirely synthetic and can be designed to possess desired properties such as length, cysteine composition and flexibility.

A number of modified hinge regions have been described for example, in U.S. Pat. No. 5,677,425, WO9915549, WO2005003170, WO2005003169, WO2005003170, WO9825971 and WO2005003171.

Examples of suitable hinge sequences are shown in Table 6.

TABLE 6

Hinge Sequences

| Hinge Name | Hinge Description | Hinge Sequence | SEQ ID NO: |
|---|---|---|---|
| H1 | Human IgA1 | VPSTPPTPSPSTPPTPSPS | 4 |
| H2 | Human IgA2 | VPPPPP | 5 |
| H3 | Human IgD | ESPKAQASSVPTAQPQAEGSLAKATTAPATTRN TGRGGEEKKKEKEKEEQEERETKTP | 6 |
| H4 | Human IgG1 | EPKSCDKTHTCPPCP | 7 |
| H5 | Human IgG2 | ERKCCVECPPCP | 8 |
| H6 | Human IgG3 | ELKTPLGDTTHTCPRCPEPKSCDTPPPCPRCPE PKSCDTPPPCPRCPEPKSCDTPPPCPRCP | 9 |
| H7 | Human IgG4 | ESKYGPPCPSCP | 10 |
| H8 | Human IgG4(P) | ESKYGPPCPPCP | 11 |
| H9 | Engineered v1 | CPPC | 2 |

TABLE 6-continued

| Hinge Name | Hinge Description | Hinge Sequence | SEQ ID NO: |
|---|---|---|---|
| | | Hinge Sequences | |
| H10 | Engineered v2 | CPSC | 12 |
| H11 | Engineered v3 | CPRC | 13 |
| H12 | Engineered v4 | SPPC | 14 |
| H13 | Engineered v5 | CPPS | 15 |
| H14 | Engineered v6 | SPPS | 3 |
| H15 | Engineered v7 | DKTHTCAA | 16 |
| H16 | Engineered v8 | DKTHTCPPCPA | 17 |
| H17 | Engineered v9 | DKTHTCPPCPATCPPCPA | 18 |
| H18 | Engineered v10 | DKTHTCPPCPATCPPCPATCPPCPA | 19 |
| H19 | Engineered v11 | DKTHTCPPCPAGKPTLYNSLVMSDTAGTCY | 20 |
| H20 | Engineered v12 | DKTHTCPPCPAGKPTHVNVSVVMAEVDGTCY | 21 |
| H21 | Engineered v13 | DKTHTCCVECPPCPA | 22 |
| H22 | Engineered v14 | DKTHTCPRCPEPKSCDTPPPCPRCPA | 23 |
| H23 | Engineered v15 | DKTHTCPSCPA | 24 |

In one embodiment, the heavy chain Fc region possesses an intact hinge region at its N-terminus.

In one embodiment, the heavy chain Fc region and hinge region are derived from IgG4 and the hinge region comprises the modified sequence CPPC (SEQ ID NO: 2). The core hinge region of human IgG4 contains the sequence CPSC (SEQ ID NO: 12) compared to IgG1 which contains the sequence CPPC (SEQ ID NO: 2). The serine residue present in the IgG4 sequence leads to increased flexibility in this region, and therefore a proportion of molecules form disulfide bonds within the same protein chain (an intrachain disulfide) rather than bridging to the other heavy chain in the IgG molecule to form the interchain disulfide. (Angel et al., 1993, Mol Immunol 30(1):105-108). Changing the serine residue to a proline to give the same core sequence as IgG1 allows complete formation of inter-chain disulfides in the IgG4 hinge region, thus reducing heterogeneity in the purified product. This altered isotype is termed IgG4P.

7.3.3. ABM Linkers

In certain aspects, the present disclosure provides MBMs (e.g., TBMs) comprising at least three ABMs, where two or more components of an ABM (e.g., a VH and a VL of an scFv), two or more ABMs, or an ABM and a non-ABM domain (e.g., a dimerization domain such as an Fc region) are connected to one another by a peptide linker. Such linkers are referred to herein an "ABM linkers", as opposed to the ADC linkers used to attach drugs to MBMs as described, for example, in Section 7.10.2.

A peptide linker can range from 2 amino acids to 60 or more amino acids, and in certain aspects a peptide linker ranges from 3 amino acids to 50 amino acids, from 4 to 30 amino acids, from 5 to 25 amino acids, from 10 to 25 amino acids or from 12 to 20 amino acids. In particular embodiments, a peptide linker is 2 amino acids, 3 amino acids, 4 amino acid, 5 amino acids, 6 amino acids, 7 amino acids, 8 amino acids, 9 amino acids, 10 amino acids, 11 amino acids, 12 amino acids, 13 amino acids, 14 amino acid, 15 amino acids, 16 amino acids, 17 amino acids, 18 amino acids, 19 amino acids, 20 amino acids, 21 amino acids, 22 amino acids, 23 amino acids, 24 amino acid, 25 amino acids, 26 amino acids, 27 amino acids, 28 amino acids, 29 amino acids, 30 amino acids, 31 amino acids, 32 amino acids, 33 amino acids, 34 amino acid, 35 amino acids, 36 amino acids, 37 amino acids, 38 amino acids, 39 amino acids, 40 amino acids, 41 amino acids, 42 amino acids, 43 amino acids, 44 amino acid, 45 amino acids, 46 amino acids, 47 amino acids, 48 amino acids, 49 amino acids, or 50 amino acids in length.

Charged and/or flexible linkers can be used.

Examples of flexible ABM linkers that can be used in the MBMs include those disclosed by Chen et al., 2013, Adv Drug Deliv Rev. 65(10):1357-1369 and Klein et al., 2014, Protein Engineering, Design & Selection 27(10):325-330. A particularly useful flexible linker is (GGGGS)n (also referred to as (G4S)n) (SEQ ID NO: 25). In some embodiments, n is any number between 1 and 10, i.e., 1, 2, 3, 4, 5, 6, 7, 8, 9, and 10, or any range bounded by any two of the foregoing numbers, e.g., 1 to 5, 2 to 5, 3 to 6, 2 to 4, 1 to 4, and so on and so forth.

Other examples of suitable ABM linkers for use in the MBMs of the present disclosure are shown in Table 7 below:

TABLE 7

| ABM Linker Sequences | | |
| --- | --- | --- |
| Linker Name | Linker Sequence | SEQ ID NO: |
| L1 | ADAAP | 26 |
| L2 | ADAAPTVSIFP | 27 |
| L3 | ADAAPTVSIFPP | 28 |
| L4 | AKTTAP | 29 |
| L5 | AKTTAPSVYPLAP | 30 |
| L6 | AKTTPKLEEGEFSEARV | 31 |
| L7 | AKTTPKLGG | 32 |
| L8 | AKTTPP | 33 |
| L9 | AKTTPPSVTPLAP | 34 |
| L10 | ASTKGP | 35 |
| L11 | ASTKGPSVFPLAP | 36 |
| L12 | ASTKGPSVFPLAPASTKGPSVFPLAP | 37 |
| L13 | EGKSSGSGSESKST | 38 |
| L14 | GEGESGEGESGEGES | 39 |
| L15 | GEGESGEGESGEGESGEGES | 40 |
| L16 | GEGGSGEGGSGEGGS | 41 |
| L17 | GENKVEYAPALMALS | 42 |
| L18 | GGEGSGGEGSGGEGS | 43 |
| L19 | GGGESGGEGSGEGGS | 44 |
| L20 | GGGESGGGESGGGES | 45 |
| L21 | $(GGGGS)_n$ (also referred to as $(G4S)_n$), where n can be 1-10. | 46 |
| L22 | GGGGSGGGGS | 47 |
| L23 | GGGGSGGGGSGGGGS | 1 |
| L24 | GGGGSGGGGSGGGGSGGGGS | 48 |
| L25 | GGGKSGGGKSGGGKS | 49 |
| L26 | GGGKSGGKGSGKGGS | 50 |
| L27 | GGKGSGGKGSGGKGS | 51 |
| L28 | GGSGG | 52 |
| L29 | GGSGGGGSG | 53 |
| L30 | GGSGGGGSGGGGS | 54 |
| L31 | GHEAAAVMQVQYPAS | 55 |
| L32 | GKGGSGKGGSGKGGS | 56 |
| L33 | GKGKSGKGKSGKGKS | 57 |
| L34 | GKGKSGKGKSGKGKSGKGKS | 58 |
| L35 | GKPGSGKPGSGKPGS | 59 |
| L36 | GKPGSGKPGSGKPGSGKPGS | 60 |
| L37 | GPAKELTPLKEAKVS | 61 |

TABLE 7-continued

ABM Linker Sequences

| Linker Name | Linker Sequence | SEQ ID NO: |
|---|---|---|
| L38 | GSAGSAAGSGEF | 62 |
| L39 | IRPRAIGGSKPRVA | 63 |
| L40 | KESGSVSSEQLAQFRSLD | 64 |
| L41 | KTTPKLEEGEFSEAR | 65 |
| L42 | QPKAAP | 66 |
| L43 | QPKAAPSVTLFPP | 67 |
| L44 | RADAAAA(G4S)$_4$ | 68 |
| L45 | RADAAAAGGPGS | 69 |
| L46 | RADAAP | 70 |
| L47 | RADAAPTVS | 71 |
| L48 | SAKTTP | 72 |
| L49 | SAKTTPKLEEGEFSEARV | 73 |
| L50 | SAKTTPKLGG | 74 |
| L51 | STAGDTHLGGEDFD | 75 |
| L52 | TVAAP | 76 |
| L53 | TVAAPSVFIFPP | 77 |
| L54 | TVAAPSVFIFPPTVAAPSVFIFPP | 78 |

In various aspects, the disclosure provides a MBM (e.g., a TBM) which comprises one or more ABM linkers. Each of the ABM linkers can be range from 2 amino acids to 60 amino acids in length, e.g., 4 to 30 amino acids, from 5 to 25 amino acids, from 10 to 25 amino acids or from 12 to 20 amino acids in length, optionally selected from Table 7 above. In particular embodiments, the MBM comprises two, three, four, five or six ABM linkers. The ABM linkers can be on one, two, three, four or even more polypeptide chains of the MBM.

7.4. Exemplary Trispecific Binding Molecules

Exemplary TBM configurations are shown in FIG. 1. FIG. 1A shows the components of the TBM configurations shown in FIGS. 1B-1V. The scFv, Fab, non-immunoglobulin based ABM, and Fc each can have the characteristics described for these components in Sections 7.2 and 7.3. The components of the TBM configurations shown in FIG. 1 can be associated with each other by any of the means described in Sections 7.2 and 7.3 (e.g., by direct bonds, ABM linkers, disulfide bonds, Fc domains with modified with knob-in-hole interactions, etc.). The orientations and associations of the various components shown in FIG. 1 are merely exemplary; as will be appreciated by a skilled artisan, other orientations and associations can be suitable (e.g., as described in Sections 7.2 and 7.3).

TBMs are not limited to the configurations shown in FIG. 1. Other configurations that can be used are known to those skilled in the art. See, e.g., WO 2014/145806; WO 2017/124002; Liu et al., 2017, Front Immunol. 8:38; Brinkmann & Kontermann, 2017, mAbs 9:2, 182-212; US 2016/0355600; Klein et al., 2016, MAbs 8(6):1010-20; and US 2017/0145116.

7.4.1. Exemplary Trivalent TBMs

The TBMs of the disclosure can be trivalent, i.e., they have three antigen-binding domains, one of which binds BCMA, one of which binds a component of a TCR complex, and one of which binds either CD2 or a TAA.

Exemplary trivalent TBM configurations are shown in FIGS. 1B through 1P.

As depicted in FIGS. 1B-1K and 1N-1P, a TBM can comprise two half antibodies, one comprising two ABMs and the other comprising one ABM, the two halves paired through an Fc domain.

In the embodiment of FIG. 1B, the first (or left) half antibody comprises an scFv and an Fc region, and the second (or right) half antibody comprises a Fab, an scFv and an Fc region. The first and second half antibodies are associated through the Fc regions forming an Fc domain.

In the embodiment of FIG. 1C, the first (or left) half antibody comprises two Fab and an Fc region, and the second (or right) half antibody comprises a Fab and an Fc region. The first and second half antibodies are associated through the Fc regions forming an Fc domain.

In the embodiment of FIG. 1D, the first (or left) half antibody comprises a Fab, an scFv and an Fc region, and the second (or right) half antibody comprises a Fab and an Fc region. The first and second half antibodies are associated through the Fc regions forming an Fc domain.

In the embodiment of FIG. 1E, the first (or left) half antibody comprises an scFv and an Fc region, and the second (or right) half antibody comprises two Fab and an Fc region. The first and second half antibodies are associated through the Fc regions forming an Fc domain.

In the embodiment of FIG. 1F, the first (or left) half antibody comprises an scFv, an Fc region, and a Fab, and the second (or right) half antibody comprises a Fab and an Fc region. The first and second half antibodies are associated through the Fc regions forming an Fc domain.

In the embodiment of FIG. 1G, the first (or left) half antibody comprises an scFv and an Fc region, and the second (or right) half antibody comprises a Fab an Fc region, and an scFV. The first and second half antibodies are associated through the Fc regions forming an Fc domain.

In the embodiment of FIG. 1H, the first (or left) half antibody comprises two Fab and an Fc region, and the second (or right) half antibody comprises a non-immuno-globulin based ABM and an Fc region. The first and second half antibodies are associated through the Fc regions forming an Fc domain.

In the embodiment of FIG. 1I, the first (or left) half antibody comprises a Fab, an scFv, and an Fc region, and the second (or right) half antibody comprises a non-immuno-globulin based ABM and an Fc region. The first and second half antibodies are associated through the Fc regions forming an Fc domain.

In the embodiment of FIG. 1J, the first (or left) half antibody comprises a Fab and an Fc region, and the second (or right) half antibody comprises an scFv, a non-immuno-globulin based ABM and an Fc region. The first and second half antibodies are associated through the Fc regions forming an Fc domain.

In the embodiment of FIG. 1K, the first (or left) half antibody comprises an scFv and an Fc region, and the second (or right) half antibody comprises an scFv, an Fc region, and a second scFv. The first and second half antibodies are associated through the Fc regions forming an Fc domain.

In the embodiment of FIG. 1N, the first (or left) half antibody comprises a Fab, an Fc region, and an scFv, and the second (or right) half antibody comprises a Fab, and an Fc region. The first and second half antibodies are associated through the Fc regions forming an Fc domain.

In the embodiment of FIG. 1O, the first (or left) half antibody comprises a Fab, an Fc region, and a scFab, and the second (or right) half antibody comprises a Fab and an Fc region. The first and second half antibodies are associated through the Fc regions forming an Fc domain.

In the embodiment of FIG. 1P, the first (or left) half antibody comprises a Fab, a non-immunoglobulin based ABM, and an Fc region, and the second (or right) half antibody comprises a scFv and an Fc region. The first and second half antibodies are associated through the Fc regions forming an Fc domain.

Alternatively, as depicted in FIG. 1L, trivalent a TBM can comprise two half antibodies, each comprising one complete ABM and a portion of another ABM (one a VH, the other a VL). The two half antibodies are paired through an Fc domain, whereupon the VH and the VL associate to form a complete antigen-binding Fv domain.

The TBM can be a single chain, as shown in FIG. 1M. The TBM of FIG. 1M comprises three scFv domains connected through linkers.

In each of the configurations shown in FIGS. 1B-1P, each of the domains designated X, Y, and Z represents an ABM1, ABM2, or ABM3, although not necessarily in that order. In other words, X can be ABM1, ABM2, or ABM3, Y can be ABM1, ABM2, or ABM3, and Z can be ABM1, ABM2, or ABM3, provided that the TBM comprises one ABM1, one ABM2, and one ABM3.

Accordingly, in the present disclosure provides a trivalent TBM as shown in any one of FIGS. 1B through 1P, where X is an ABM1, Y is an ABM3 and Z is an ABM2 (this configuration of ABMs designated as "T1" for convenience).

The present disclosure also provides a trivalent TBM as shown in any one of FIGS. 1B through 1P, where X is an ABM1, Y is an ABM2, and Z is an ABM3 (this configuration of ABMs designated as "T2" for convenience).

The present disclosure further provides a trivalent TBM as shown in any one of FIGS. 1B through 1P, where X is an ABM3, Y is an ABM1, and Z is an ABM2 (this configuration of ABMs designated as "T3" for convenience).

The present disclosure yet further provides a trivalent TBM as shown in any one of FIGS. 1B through 1P, where X is an ABM3, Y is an ABM2, and Z is an ABM1 (this configuration of ABMs designated as "T4" for convenience).

The present disclosure yet further provides a trivalent TBM as shown in any one of FIGS. 1B through 1P, where X is an ABM2, Y is an ABM1, and Z is an ABM3 (this configuration of ABMs designated as "T5" for convenience).

The present disclosure yet further provides a trivalent TBM as shown in any one of FIGS. 1B through 1P, where X is an ABM2, Y is an ABM3, and Z is an ABM1 (this configuration of ABMs designated as "T6" for convenience).

7.4.2. Exemplary Tetravalent TBMs

The TBMs of the disclosure can be tetravalent, i.e., they have four antigen-binding domains, one or two of which binds BCMA, one or two of which binds a component of a TCR complex, and one or two of which binds CD2 or a TAA.

Exemplary tetravalent TBM configurations are shown in FIGS. 1Q-1S.

As depicted in FIGS. 1Q-1S, a tetravalent TBM can comprise two half antibodies, each comprising two complete ABMs, the two halves paired through an Fc domain.

In the embodiment of FIG. 1Q, the first (or left) half antibody comprises a Fab, an Fc region, and a second Fab, and the second (or right) half antibody comprises a Fab, an Fc region, and a second Fab. The first and second half antibodies are associated through the Fc regions forming an Fc domain.

In the embodiment of FIG. 1R, the first (or left) half antibody comprises a Fab, an Fc region, and an scFv, and the second (or right) half antibody comprises a Fab, an Fc region, and an scFv. The first and second half antibodies are associated through the Fc regions forming an Fc domain.

In the embodiment of FIG. 1S, the first (or left) half antibody comprises a Fab, an Fc region, and an scFv, and the second (or right) half antibody comprises an scFv, an Fc region, and a Fab. The first and second half antibodies are associated through the Fc regions forming an Fc domain.

In the configuration shown in FIGS. 1Q-1S, each of X, Y, Z, and A represent an ABM1, an ABM2, or an ABM3, although not necessarily in that order, and provided that the TBM comprises at least one ABM1, at least one ABM2, and at least one ABM3. Thus, the tetravalent ABMs will include two ABMs against one of BCMA, a component of a TCR complex, and CD2 or a TAA. In some cases, a tetravalent TBM has two BCMA ABMs.

Accordingly, the present disclosure provides tetravalent TBMs as shown in any one of FIGS. 1Q-1S, where X, Y, Z, and A are ABMs directed to BCMA, a component of a TCR complex and CD2 or a TAA, as shown in Table 8.

TABLE 8

| | ABM Permutations in Tetravalent TBMs | | | |
| --- | --- | --- | --- | --- |
| Tetravalent Configuration | X | Y | Z | A |
| Tv 1 | BCMA | BCMA | CD2 or TAA | TCR |
| Tv 2 | BCMA | BCMA | TCR | CD2 or TAA |
| Tv 3 | BCMA | CD2 or TAA | BCMA | TCR |
| Tv 4 | BCMA | TCR | BCMA | CD2 or TAA |
| Tv 5 | BCMA | CD2 or TAA | TCR | BCMA |
| Tv 6 | BCMA | TCR | CD2 or TAA | BCMA |
| Tv 7 | CD2 or TAA | BCMA | BCMA | TCR |
| Tv 8 | TCR | BCMA | BCMA | CD2 or TAA |
| Tv 9 | CD2 or TAA | BCMA | TCR | BCMA |
| Tv 10 | TCR | BCMA | CD2 or TAA | BCMA |
| Tv 11 | CD2 or TAA | TCR | BCMA | BCMA |
| Tv 12 | TCR | CD2 or TAA | BCMA | BCMA |
| Tv 13 | BCMA | CD2 or TAA | TCR | TCR |
| Tv 14 | BCMA | TCR | CD2 or TAA | TCR |
| Tv 15 | BCMA | TCR | TCR | CD2 or TAA |
| Tv 16 | CD2 or TAA | BCMA | TCR | TCR |
| Tv 17 | TCR | BCMA | CD2 or TAA | TCR |
| Tv 18 | TCR | BCMA | TCR | CD2 or TAA |
| Tv 19 | CD2 or TAA | TCR | BCMA | TCR |
| Tv 20 | TCR | CD2 or TAA | BCMA | TCR |
| Tv 21 | TCR | TCR | BCMA | CD2 or TAA |
| Tv 22 | CD2 or TAA | TCR | TCR | BCMA |
| Tv 23 | TCR | CD2 or TAA | TCR | BCMA |
| Tv 24 | TCR | TCR | CD2 or TAA | BCMA |

7.4.3. Exemplary Pentavalent TBMs

The TBMs of the disclosure can be pentavalent, i.e., they have five antigen-binding domains, one, two, or three of which binds BCMA, one, two, or three of which binds a component of a TCR complex, and one, two, or three of which binds CD2 or a TAA.

An exemplary pentavalent TBM configuration is shown in FIG. 1T.

As depicted in FIG. 1T, a pentavalent TBM can comprise two half antibodies, one of which comprises two complete ABMs and the other of which comprises one complete ABM, the two halves paired through an Fc domain.

In the embodiment of FIG. 1T, the first (or left) half antibody comprises a Fab, an scFv, and an Fc region, and the second (or right) half antibody comprises a Fab, an Fc region, and an scFv. The first and second half antibodies are associated through the Fc regions forming an Fc domain.

In the configuration shown in FIG. 1T, each of X, Y, Z, A, and B represent an ABM1, an ABM2, or an ABM3, although not necessarily in that order, and provided that the TBM comprises at least one ABM1, one ABM2, and one ABM3. Thus, the pentavalent TBMs can include two ABMs against two of BCMA, a component of a TCR complex, and CD2 or a TAA, or three ABMs against one of BCMA, a component of a TCR complex, and CD2 or a TAA. In some cases, a pentavalent TBM has two or three BCMA ABMs. In some embodiments, a pentavalent TBM has three ABM1s, one ABM2 and one ABM3.

Accordingly, the present disclosure provides a pentavalent TBM as shown in FIG. 1T, where X, Y, Z, A, and B are ABMs directed to BCMA, a component of a TCR complex, and CD2 or a TAA as shown in Table 9.

TABLE 9

| | ABM Permutations in Pentavalent TBMs | | | | |
| --- | --- | --- | --- | --- | --- |
| Pentavalent Configuration | X | Y | Z | A | B |
| Pv 1 | BCMA | BCMA | BCMA | CD2 or TAA | TCR |
| Pv 2 | BCMA | BCMA | BCMA | TCR | CD2 or TAA |
| Pv 3 | BCMA | BCMA | CD2 or TAA | BCMA | TCR |
| Pv 4 | BCMA | BCMA | TCR | BCMA | CD2 or TAA |
| Pv 5 | BCMA | BCMA | CD2 or TAA | TCR | BCMA |
| Pv 6 | BCMA | BCMA | TCR | CD2 or TAA | BCMA |
| Pv 7 | BCMA | CD2 or TAA | BCMA | BCMA | TCR |
| Pv 8 | BCMA | TCR | BCMA | BCMA | CD2 or TAA |
| Pv 9 | BCMA | CD2 or TAA | BCMA | TCR | BCMA |
| Pv 10 | BCMA | TCR | BCMA | CD2 or TAA | BCMA |
| Pv 11 | BCMA | CD2 or TAA | TCR | BCMA | BCMA |
| Pv 12 | BCMA | TCR | CD2 or TAA | BCMA | BCMA |
| Pv 13 | CD2 or TAA | BCMA | BCMA | BCMA | TCR |
| Pv 14 | TCR | BCMA | BCMA | BCMA | CD2 or TAA |
| Pv 15 | CD2 or TAA | BCMA | BCMA | TCR | BCMA |
| Pv 16 | TCR | BCMA | BCMA | CD2 or TAA | BCMA |
| Pv 17 | CD2 or TAA | BCMA | TCR | BCMA | BCMA |
| Pv 18 | TCR | BCMA | CD2 or TAA | BCMA | BCMA |
| Pv 19 | CD2 or TAA | TCR | BCMA | BCMA | BCMA |
| Pv 20 | TCR | CD2 or TAA | BCMA | BCMA | BCMA |
| Pv 21 | BCMA | BCMA | CD2 or TAA | CD2 or TAA | TCR |
| Pv 22 | BCMA | BCMA | CD2 or TAA | TCR | CD2 or TAA |
| Pv 23 | BCMA | BCMA | TCR | CD2 or TAA | CD2 or TAA |
| Pv 24 | BCMA | CD2 or TAA | BCMA | CD2 or TAA | TCR |
| Pv 25 | BCMA | CD2 or TAA | BCMA | TCR | CD2 or TAA |
| Pv 26 | BCMA | TCR | BCMA | CD2 or TAA | CD2 or TAA |
| Pv 27 | BCMA | CD2 or TAA | CD2 or TAA | BCMA | TCR |
| Pv 28 | BCMA | CD2 or TAA | TCR | BCMA | CD2 or TAA |
| Pv 29 | BCMA | TCR | CD2 or TAA | BCMA | CD2 or TAA |
| Pv 30 | BCMA | CD2 or TAA | CD2 or TAA | TCR | BCMA |
| Pv 31 | BCMA | CD2 or TAA | TCR | CD2 or TAA | BCMA |
| Pv 32 | BCMA | TCR | CD2 or TAA | CD2 or TAA | BCMA |
| Pv 33 | CD2 or TAA | BCMA | BCMA | CD2 or TAA | TCR |
| Pv 34 | CD2 or TAA | BCMA | BCMA | TCR | CD2 or TAA |
| Pv 35 | TCR | BCMA | BCMA | CD2 or TAA | CD2 or TAA |
| Pv 36 | CD2 or TAA | BCMA | CD2 or TAA | BCMA | TCR |
| Pv 37 | CD2 or TAA | BCMA | TCR | BCMA | CD2 or TAA |

TABLE 9-continued

ABM Permutations in Pentavalent TBMs

| Pentavalent Configuration | X | Y | Z | A | B |
|---|---|---|---|---|---|
| Pv 38 | TCR | BCMA | CD2 or TAA | BCMA | CD2 or TAA |
| Pv 39 | CD2 or TAA | BCMA | CD2 or TAA | TCR | BCMA |
| Pv 40 | CD2 or TAA | BCMA | TCR | CD2 or TAA | BCMA |
| Pv 41 | TCR | BCMA | CD2 or TAA | CD2 or TAA | BCMA |
| Pv 42 | CD2 or TAA | CD2 or TAA | BCMA | BCMA | TCR |
| Pv 43 | CD2 or TAA | TCR | BCMA | BCMA | CD2 or TAA |
| Pv 44 | TCR | CD2 or TAA | BCMA | BCMA | CD2 or TAA |
| Pv 45 | CD2 or TAA | CD2 or TAA | BCMA | TCR | BCMA |
| Pv 46 | CD2 or TAA | TCR | BCMA | CD2 or TAA | BCMA |
| Pv 47 | TCR | CD2 or TAA | BCMA | CD2 or TAA | BCMA |
| Pv 48 | CD2 or TAA | CD2 or TAA | TCR | BCMA | BCMA |
| Pv 49 | CD2 or TAA | TCR | CD2 or TAA | BCMA | BCMA |
| Pv 50 | TCR | CD2 or TAA | CD2 or TAA | BCMA | BCMA |
| Pv 51 | BCMA | BCMA | CD2 or TAA | TCR | TCR |
| Pv 52 | BCMA | BCMA | TCR | CD2 or TAA | TCR |
| Pv 53 | BCMA | BCMA | TCR | TCR | CD2 or TAA |
| Pv 54 | BCMA | CD2 or TAA | BCMA | TCR | TCR |
| Pv 55 | BCMA | TCR | BCMA | CD2 or TAA | TCR |
| Pv 56 | BCMA | TCR | BCMA | TCR | CD2 or TAA |
| Pv 57 | BCMA | CD2 or TAA | TCR | BCMA | TCR |
| Pv 58 | BCMA | TCR | CD2 or TAA | BCMA | TCR |
| Pv 59 | BCMA | TCR | TCR | BCMA | CD2 or TAA |
| Pv 60 | BCMA | CD2 or TAA | TCR | TCR | BCMA |
| Pv 61 | BCMA | TCR | CD2 or TAA | TCR | BCMA |
| Pv 62 | BCMA | TCR | TCR | CD2 or TAA | BCMA |
| Pv 63 | CD2 or TAA | BCMA | BCMA | TCR | TCR |
| Pv 64 | TCR | BCMA | BCMA | CD2 or TAA | TCR |
| Pv 65 | TCR | BCMA | BCMA | TCR | CD2 or TAA |
| Pv 66 | CD2 or TAA | BCMA | TCR | BCMA | TCR |
| Pv 67 | TCR | BCMA | CD2 or TAA | BCMA | TCR |
| Pv 68 | TCR | BCMA | TCR | BCMA | CD2 or TAA |
| Pv 69 | CD2 or TAA | BCMA | TCR | TCR | BCMA |
| Pv 70 | TCR | BCMA | CD2 or TAA | TCR | BCMA |
| Pv 71 | TCR | BCMA | TCR | CD2 or TAA | BCMA |
| Pv 72 | CD2 or TAA | TCR | BCMA | BCMA | TCR |
| Pv 73 | TCR | CD2 or TAA | BCMA | BCMA | TCR |
| Pv 74 | TCR | TCR | BCMA | BCMA | CD2 or TAA |
| Pv 75 | CD2 or TAA | TCR | BCMA | TCR | BCMA |
| Pv 76 | TCR | CD2 or TAA | BCMA | TCR | BCMA |
| Pv 77 | TCR | TCR | BCMA | CD2 or TAA | BCMA |
| Pv 78 | CD2 or TAA | TCR | TCR | BCMA | BCMA |
| Pv 79 | TCR | CD2 or TAA | TCR | BCMA | BCMA |
| Pv 80 | TCR | TCR | CD2 or TAA | BCMA | BCMA |
| Pv 81 | BCMA | CD2 or TAA | TCR | TCR | TCR |
| Pv 82 | BCMA | TCR | CD2 or TAA | TCR | TCR |
| Pv 83 | BCMA | TCR | TCR | CD2 or TAA | TCR |
| Pv 84 | BCMA | TCR | TCR | TCR | CD2 or TAA |
| Pv 85 | CD2 or TAA | BCMA | TCR | TCR | TCR |
| Pv 86 | TCR | BCMA | CD2 or TAA | TCR | TCR |
| Pv 87 | TCR | BCMA | TCR | CD2 or TAA | TCR |
| Pv 88 | TCR | BCMA | TCR | TCR | CD2 or TAA |
| Pv 89 | CD2 or TAA | TCR | BCMA | TCR | TCR |
| Pv 90 | TCR | CD2 or TAA | BCMA | TCR | TCR |
| Pv 91 | TCR | TCR | BCMA | CD2 or TAA | TCR |
| Pv 92 | TCR | TCR | BCMA | TCR | CD2 or TAA |
| Pv 93 | CD2 or TAA | TCR | TCR | BCMA | TCR |
| Pv 94 | TCR | CD2 or TAA | TCR | BCMA | TCR |
| Pv 95 | TCR | TCR | CD2 or TAA | BCMA | TCR |
| Pv 96 | TCR | TCR | TCR | BCMA | CD2 or TAA |
| Pv 97 | CD2 or TAA | TCR | TCR | TCR | BCMA |
| Pv 98 | TCR | CD2 or TAA | TCR | TCR | BCMA |
| Pv 99 | TCR | TCR | CD2 or TAA | TCR | BCMA |
| Pv 100 | TCR | TCR | TCR | CD2 or TAA | BCMA |

7.4.4. Exemplary Hexavalent TBMs

The TBMs of the disclosure can be hexavalent, i.e., they have six antigen-binding domains, one, two, three, or four of which binds BCMA, one, two, three, or four of which binds a component of a TCR complex, and one, two, three, or four of which binds CD2 or a TAA.

Exemplary hexavalent TBM configurations are shown in FIGS. 1U-1V.

As depicted in FIGS. 1U-1V, a pentavalent TBM can comprise two half antibodies, one of which comprises two complete ABMs and the other of which comprises one complete ABM, the two halves paired through an Fc domain.

In the embodiment of FIG. 1U, the first (or left) half antibody comprises a Fab, a second Fab, an Fc region, and an scFv, and the second (or right) half antibody comprises a Fab, a second Fab, an Fc region, and an scFv. The first and second half antibodies are associated through the Fc regions forming an Fc domain.

In the embodiment of FIG. 1V, the first (or left) half antibody comprises a first Fv, a second Fv, a third Fv, and an Fc region, and the second (or right) half antibody comprises a first Fv, a second Fv, a third Fv, and an Fc region. The first and second half antibodies are associated through the Fc regions forming an Fc domain.

In the configuration shown in FIGS. 1U-1V, each of X, Y, Z, A, B, and C represent an ABM1, an ABM2, or an ABM3, although not necessarily in that order, and provided that the TBM comprises at least one ABM1, one ABM2, and one ABM3. Thus, the hexavalent TBMs can include (i) two ABMs against each of BCMA, a component of a TCR complex, and CD2 or a TAA, (ii) three ABMs against one of BCMA, a component of a TCR complex, and CD2 or a TAA, or (iii) four ABMs against one of BCMA, a component of a TCR complex, and CD2 or a TAA. For example, a hexavalent ABM can include three ABMs against BCMA, two ABMs against CD2 or a TAA and one ABM against a component of a TCR complex. As another example, a hexavalent ABM can include three ABMs against BCMA, two ABMs against a component of a TCR complex and one ABM against CD2 or a TAA. In some cases, a hexavalent TBM has two, three, our four BCMA ABMs. In some embodiments, a hexavalent TBM has three BCMA ABMs. In other embodiments, a hexavalent TBM has four BCMA ABMs.

Accordingly, in the present disclosure provides hexavalent TBMs as shown in any one of FIGS. 1U-1V, where X, Y, Z, A, B, and C are ABMs directed to BCMA, a component of a TCR complex, and CD2 or a TAA, as shown in Table 10.

TABLE 10

| ABM Permutations in Hexavalent TBMs | | | | | |
|---|---|---|---|---|---|
| Hexavalent Configuration | X | Y | Z | A | B | C |
| Hv 1 | BCMA | BCMA | BCMA | BCMA | CD2 or TAA | TCR |
| Hv 2 | BCMA | BCMA | BCMA | BCMA | TCR | CD2 or TAA |
| Hv 3 | BCMA | BCMA | BCMA | CD2 or TAA | BCMA | TCR |
| Hv 4 | BCMA | BCMA | BCMA | TCR | BCMA | CD2 or TAA |
| Hv 5 | BCMA | BCMA | BCMA | CD2 or TAA | TCR | BCMA |
| Hv 6 | BCMA | BCMA | BCMA | TCR | CD2 or TAA | BCMA |
| Hv 7 | BCMA | BCMA | CD2 or TAA | BCMA | BCMA | TCR |
| Hv 8 | BCMA | BCMA | TCR | BCMA | BCMA | CD2 or TAA |
| Hv 9 | BCMA | BCMA | CD2 or TAA | BCMA | TCR | BCMA |
| Hv 10 | BCMA | BCMA | TCR | BCMA | CD2 or TAA | BCMA |
| Hv 11 | BCMA | BCMA | CD2 or TAA | TCR | BCMA | BCMA |
| Hv 12 | BCMA | BCMA | TCR | CD2 or TAA | BCMA | BCMA |
| Hv 13 | BCMA | CD2 or TAA | BCMA | BCMA | BCMA | TCR |
| Hv 14 | BCMA | TCR | BCMA | BCMA | BCMA | CD2 or TAA |
| Hv 15 | BCMA | CD2 or TAA | BCMA | BCMA | TCR | BCMA |

TABLE 10-continued

| ABM Permutations in Hexavalent TBMs | | | | | |
|---|---|---|---|---|---|
| Hexavalent Configuration | X | Y | Z | A | B | C |
| Hv 16 | BCMA | TCR | BCMA | BCMA | CD2 or TAA | BCMA |
| Hv 17 | BCMA | CD2 or TAA | BCMA | TCR | BCMA | BCMA |
| Hv 18 | BCMA | TCR | BCMA | CD2 or TAA | BCMA | BCMA |
| Hv 19 | BCMA | CD2 or TAA | TCR | BCMA | BCMA | BCMA |
| Hv 20 | BCMA | TCR | CD2 or TAA | BCMA | BCMA | BCMA |
| Hv 21 | CD2 or TAA | BCMA | BCMA | BCMA | BCMA | TCR |
| Hv 22 | TCR | BCMA | BCMA | BCMA | BCMA | CD2 or TAA |
| Hv 23 | CD2 or TAA | BCMA | BCMA | BCMA | TCR | BCMA |
| Hv 24 | TCR | BCMA | BCMA | BCMA | CD2 or TAA | BCMA |
| Hv 25 | CD2 or TAA | BCMA | BCMA | TCR | BCMA | BCMA |
| Hv 26 | TCR | BCMA | BCMA | CD2 or TAA | BCMA | BCMA |
| Hv 27 | CD2 or TAA | BCMA | TCR | BCMA | BCMA | BCMA |
| Hv 28 | TCR | BCMA | CD2 or TAA | BCMA | BCMA | BCMA |
| Hv 29 | CD2 or TAA | TCR | BCMA | BCMA | BCMA | BCMA |
| Hv 30 | TCR | CD2 or TAA | BCMA | BCMA | BCMA | BCMA |
| Hv 31 | BCMA | BCMA | BCMA | CD2 or TAA | CD2 or TAA | TCR |
| Hv 32 | BCMA | BCMA | BCMA | CD2 or TAA | TCR | CD2 or TAA |
| Hv 33 | BCMA | BCMA | BCMA | TCR | CD2 or TAA | CD2 or TAA |
| Hv 34 | BCMA | BCMA | CD2 or TAA | BCMA | CD2 or TAA | TCR |
| Hv 35 | BCMA | BCMA | CD2 or TAA | BCMA | TCR | CD2 or TAA |
| Hv 36 | BCMA | BCMA | TCR | BCMA | CD2 or TAA | CD2 or TAA |
| Hv 37 | BCMA | BCMA | CD2 or TAA | CD2 or TAA | BCMA | TCR |
| Hv 38 | BCMA | BCMA | CD2 or TAA | TCR | BCMA | CD2 or TAA |
| Hv 39 | BCMA | BCMA | TCR | CD2 or TAA | BCMA | CD2 or TAA |
| Hv 40 | BCMA | BCMA | CD2 or TAA | CD2 or TAA | TCR | BCMA |
| Hv 41 | BCMA | BCMA | CD2 or TAA | TCR | CD2 or TAA | BCMA |
| Hv 42 | BCMA | BCMA | TCR | CD2 or TAA | CD2 or TAA | BCMA |
| Hv 43 | BCMA | CD2 or TAA | BCMA | BCMA | CD2 or TAA | TCR |
| Hv 44 | BCMA | CD2 or TAA | BCMA | BCMA | TCR | CD2 or TAA |
| Hv 45 | BCMA | TCR | BCMA | BCMA | CD2 or TAA | CD2 or TAA |
| Hv 46 | BCMA | CD2 or TAA | BCMA | CD2 or TAA | BCMA | TCR |
| Hv 47 | BCMA | CD2 or TAA | BCMA | TCR | BCMA | CD2 or TAA |
| Hv 48 | BCMA | TCR | BCMA | CD2 or TAA | BCMA | CD2 or TAA |
| Hv 49 | BCMA | CD2 or TAA | BCMA | CD2 or TAA | TCR | BCMA |
| Hv 50 | BCMA | CD2 or TAA | BCMA | TCR | CD2 or TAA | BCMA |
| Hv 51 | BCMA | TCR | BCMA | CD2 or TAA | CD2 or TAA | BCMA |
| Hv 52 | BCMA | CD2 or TAA | CD2 or TAA | BCMA | BCMA | TCR |

TABLE 10-continued

ABM Permutations in Hexavalent TBMs

| Hexavalent Configuration | X | Y | Z | A | B | C |
|---|---|---|---|---|---|---|
| Hv 53 | BCMA | CD2 or TAA | TCR | BCMA | BCMA | CD2 or TAA |
| Hv 54 | BCMA | TCR | CD2 or TAA | BCMA | BCMA | CD2 or TAA |
| Hv 55 | BCMA | CD2 or TAA | CD2 or TAA | BCMA | TCR | BCMA |
| Hv 56 | BCMA | CD2 or TAA | TCR | BCMA | CD2 or TAA | BCMA |
| Hv 57 | BCMA | TCR | CD2 or TAA | BCMA | CD2 or TAA | BCMA |
| Hv 58 | BCMA | CD2 or TAA | CD2 or TAA | TCR | BCMA | BCMA |
| Hv 59 | BCMA | CD2 or TAA | TCR | CD2 or TAA | BCMA | BCMA |
| Hv 60 | BCMA | TCR | CD2 or TAA | CD2 or TAA | BCMA | BCMA |
| Hv 61 | CD2 or TAA | BCMA | BCMA | BCMA | CD2 or TAA | TCR |
| Hv 62 | CD2 or TAA | BCMA | BCMA | BCMA | TCR | CD2 or TAA |
| Hv 63 | TCR | BCMA | BCMA | BCMA | CD2 or TAA | CD2 or TAA |
| Hv 64 | CD2 or TAA | BCMA | BCMA | CD2 or TAA | BCMA | TCR |
| Hv 65 | CD2 or TAA | BCMA | BCMA | TCR | BCMA | CD2 or TAA |
| Hv 66 | TCR | BCMA | BCMA | CD2 or TAA | BCMA | CD2 or TAA |
| Hv 67 | CD2 or TAA | BCMA | BCMA | CD2 or TAA | TCR | BCMA |
| Hv 68 | CD2 or TAA | BCMA | BCMA | TCR | CD2 or TAA | BCMA |
| Hv 69 | TCR | BCMA | BCMA | CD2 or TAA | CD2 or TAA | BCMA |
| Hv 70 | CD2 or TAA | BCMA | CD2 or TAA | BCMA | BCMA | TCR |
| Hv 71 | CD2 or TAA | BCMA | TCR | BCMA | BCMA | CD2 or TAA |
| Hv 72 | TCR | BCMA | CD2 or TAA | BCMA | BCMA | CD2 or TAA |
| Hv 73 | CD2 or TAA | BCMA | CD2 or TAA | BCMA | TCR | BCMA |
| Hv 74 | CD2 or TAA | BCMA | TCR | BCMA | CD2 or TAA | BCMA |
| Hv 75 | TCR | BCMA | CD2 or TAA | BCMA | CD2 or TAA | BCMA |
| Hv 76 | CD2 or TAA | BCMA | CD2 or TAA | TCR | BCMA | BCMA |
| Hv 77 | CD2 or TAA | BCMA | TCR | CD2 or TAA | BCMA | BCMA |
| Hv 78 | TCR | BCMA | CD2 or TAA | CD2 or TAA | BCMA | BCMA |
| Hv 79 | CD2 or TAA | CD2 or TAA | BCMA | BCMA | BCMA | TCR |
| Hv 80 | CD2 or TAA | TCR | BCMA | BCMA | BCMA | CD2 or TAA |
| Hv 81 | TCR | CD2 or TAA | BCMA | BCMA | BCMA | CD2 or TAA |
| Hv 82 | CD2 or TAA | CD2 or TAA | BCMA | BCMA | TCR | BCMA |
| Hv 83 | CD2 or TAA | TCR | BCMA | BCMA | CD2 or TAA | BCMA |
| Hv 84 | TCR | CD2 or TAA | BCMA | BCMA | CD2 or TAA | BCMA |
| Hv 85 | CD2 or TAA | CD2 or TAA | BCMA | TCR | BCMA | BCMA |
| Hv 86 | CD2 or TAA | TCR | BCMA | CD2 or TAA | BCMA | BCMA |
| Hv 87 | TCR | CD2 or TAA | BCMA | CD2 or TAA | BCMA | BCMA |
| Hv 88 | CD2 or TAA | CD2 or TAA | TCR | BCMA | BCMA | BCMA |
| Hv 89 | CD2 or TAA | TCR | CD2 or TAA | BCMA | BCMA | BCMA |
| Hv 90 | TCR | CD2 or TAA | CD2 or TAA | BCMA | BCMA | BCMA |
| Hv 91 | BCMA | BCMA | BCMA | CD2 or TAA | TCR | TCR |
| Hv 92 | BCMA | BCMA | BCMA | TCR | CD2 or TAA | TCR |
| Hv 93 | BCMA | BCMA | BCMA | TCR | TCR | CD2 or TAA |
| Hv 94 | BCMA | BCMA | CD2 or TAA | BCMA | TCR | TCR |
| Hv 95 | BCMA | BCMA | TCR | BCMA | CD2 or TAA | TCR |
| Hv 96 | BCMA | BCMA | TCR | BCMA | TCR | CD2 or TAA |
| Hv 97 | BCMA | BCMA | CD2 or TAA | TCR | BCMA | TCR |
| Hv 98 | BCMA | BCMA | TCR | CD2 or TAA | BCMA | TCR |
| Hv 99 | BCMA | BCMA | TCR | TCR | BCMA | CD2 or TAA |
| Hv 100 | BCMA | BCMA | CD2 or TAA | TCR | TCR | BCMA |
| Hv 101 | BCMA | BCMA | TCR | CD2 or TAA | TCR | BCMA |
| Hv 102 | BCMA | BCMA | TCR | TCR | CD2 or TAA | BCMA |
| Hv 103 | BCMA | CD2 or TAA | BCMA | BCMA | TCR | TCR |
| Hv 104 | BCMA | TCR | BCMA | BCMA | CD2 or TAA | TCR |
| Hv 105 | BCMA | TCR | BCMA | BCMA | TCR | CD2 or TAA |
| Hv 106 | BCMA | CD2 or TAA | BCMA | TCR | BCMA | TCR |
| Hv 107 | BCMA | TCR | BCMA | CD2 or TAA | BCMA | TCR |
| Hv 108 | BCMA | TCR | BCMA | TCR | BCMA | CD2 or TAA |
| Hv 109 | BCMA | CD2 or TAA | BCMA | TCR | TCR | BCMA |
| Hv 110 | BCMA | TCR | BCMA | CD2 or TAA | TCR | BCMA |
| Hv 111 | BCMA | TCR | BCMA | TCR | CD2 or TAA | BCMA |
| Hv 112 | BCMA | CD2 or TAA | TCR | BCMA | BCMA | TCR |
| Hv 113 | BCMA | TCR | CD2 or TAA | BCMA | BCMA | TCR |
| Hv 114 | BCMA | TCR | TCR | BCMA | BCMA | CD2 or TAA |
| Hv 115 | BCMA | CD2 or TAA | TCR | BCMA | TCR | BCMA |
| Hv 116 | BCMA | TCR | CD2 or TAA | BCMA | TCR | BCMA |
| Hv 117 | BCMA | TCR | TCR | BCMA | CD2 or TAA | BCMA |
| Hv 118 | BCMA | CD2 or TAA | TCR | TCR | BCMA | BCMA |
| Hv 119 | BCMA | TCR | CD2 or TAA | TCR | BCMA | BCMA |
| Hv 120 | BCMA | TCR | TCR | CD2 or TAA | BCMA | BCMA |
| Hv 121 | CD2 or TAA | BCMA | BCMA | BCMA | TCR | TCR |
| Hv 122 | TCR | BCMA | BCMA | BCMA | CD2 or TAA | TCR |
| Hv 123 | TCR | BCMA | BCMA | BCMA | TCR | CD2 or TAA |
| Hv 124 | CD2 or TAA | BCMA | BCMA | TCR | BCMA | TCR |
| Hv 125 | TCR | BCMA | BCMA | CD2 or TAA | BCMA | TCR |
| Hv 126 | TCR | BCMA | BCMA | TCR | BCMA | CD2 or TAA |

TABLE 10-continued

ABM Permutations in Hexavalent TBMs

| Hexavalent Configuration | X | Y | Z | A | B | C |
|---|---|---|---|---|---|---|
| Hv 127 | CD2 or TAA | BCMA | BCMA | TCR | TCR | BCMA |
| Hv 128 | TCR | BCMA | BCMA | CD2 or TAA | TCR | BCMA |
| Hv 129 | TCR | BCMA | BCMA | TCR | CD2 or TAA | BCMA |
| Hv 130 | CD2 or TAA | BCMA | TCR | BCMA | BCMA | TCR |
| Hv 131 | TCR | BCMA | CD2 or TAA | BCMA | BCMA | TCR |
| Hv 132 | TCR | BCMA | TCR | BCMA | BCMA | CD2 or TAA |
| Hv 133 | CD2 or TAA | BCMA | TCR | BCMA | TCR | BCMA |
| Hv 134 | TCR | BCMA | CD2 or TAA | BCMA | TCR | BCMA |
| Hv 135 | TCR | BCMA | TCR | BCMA | CD2 or TAA | BCMA |
| Hv 136 | CD2 or TAA | BCMA | TCR | TCR | BCMA | BCMA |
| Hv 137 | TCR | BCMA | CD2 or TAA | TCR | BCMA | BCMA |
| Hv 138 | TCR | BCMA | TCR | CD2 or TAA | BCMA | BCMA |
| Hv 139 | CD2 or TAA | TCR | BCMA | BCMA | BCMA | TCR |
| Hv 140 | TCR | CD2 or TAA | BCMA | BCMA | BCMA | TCR |
| Hv 141 | TCR | TCR | BCMA | BCMA | BCMA | CD2 or TAA |
| Hv 142 | CD2 or TAA | TCR | BCMA | BCMA | TCR | BCMA |
| Hv 143 | TCR | CD2 or TAA | BCMA | BCMA | TCR | BCMA |
| Hv 144 | TCR | TCR | BCMA | BCMA | CD2 or TAA | BCMA |
| Hv 145 | CD2 or TAA | TCR | BCMA | TCR | BCMA | BCMA |
| Hv 146 | TCR | CD2 or TAA | BCMA | TCR | BCMA | BCMA |
| Hv 147 | TCR | TCR | BCMA | CD2 or TAA | BCMA | BCMA |
| Hv 148 | CD2 or TAA | TCR | TCR | BCMA | BCMA | BCMA |
| Hv 149 | TCR | CD2 or TAA | TCR | BCMA | BCMA | BCMA |
| Hv 150 | TCR | TCR | CD2 or TAA | BCMA | BCMA | BCMA |
| Hv 151 | BCMA | BCMA | CD2 or TAA | CD2 or TAA | TCR | TCR |
| Hv 152 | BCMA | BCMA | CD2 or TAA | TCR | CD2 or TAA | TCR |
| Hv 153 | BCMA | BCMA | CD2 or TAA | TCR | TCR | CD2 or TAA |
| Hv 154 | BCMA | BCMA | TCR | CD2 or TAA | CD2 or TAA | TCR |
| Hv 155 | BCMA | BCMA | TCR | CD2 or TAA | TCR | CD2 or TAA |
| Hv 156 | BCMA | BCMA | TCR | TCR | CD2 or TAA | CD2 or TAA |
| Hv 157 | BCMA | CD2 or TAA | BCMA | CD2 or TAA | TCR | TCR |
| Hv 158 | BCMA | CD2 or TAA | BCMA | TCR | CD2 or TAA | TCR |
| Hv 159 | BCMA | CD2 or TAA | BCMA | TCR | TCR | CD2 or TAA |
| Hv 160 | BCMA | TCR | BCMA | CD2 or TAA | CD2 or TAA | TCR |
| Hv 161 | BCMA | TCR | BCMA | CD2 or TAA | TCR | CD2 or TAA |
| Hv 162 | BCMA | TCR | BCMA | TCR | CD2 or TAA | CD2 or TAA |
| Hv 163 | BCMA | CD2 or TAA | CD2 or TAA | BCMA | TCR | TCR |
| Hv 164 | BCMA | CD2 or TAA | TCR | BCMA | CD2 or TAA | TCR |
| Hv 165 | BCMA | CD2 or TAA | TCR | BCMA | TCR | CD2 or TAA |
| Hv 166 | BCMA | TCR | CD2 or TAA | BCMA | CD2 or TAA | TCR |
| Hv 167 | BCMA | TCR | CD2 or TAA | BCMA | TCR | CD2 or TAA |
| Hv 168 | BCMA | TCR | TCR | BCMA | CD2 or TAA | CD2 or TAA |
| Hv 169 | BCMA | CD2 or TAA | CD2 or TAA | TCR | BCMA | TCR |
| Hv 170 | BCMA | CD2 or TAA | TCR | CD2 or TAA | BCMA | TCR |
| Hv 171 | BCMA | CD2 or TAA | TCR | TCR | BCMA | CD2 or TAA |
| Hv 172 | BCMA | TCR | CD2 or TAA | CD2 or TAA | BCMA | TCR |
| Hv 173 | BCMA | TCR | CD2 or TAA | TCR | BCMA | CD2 or TAA |
| Hv 174 | BCMA | TCR | TCR | CD2 or TAA | BCMA | CD2 or TAA |
| Hv 175 | BCMA | CD2 or TAA | CD2 or TAA | TCR | TCR | BCMA |
| Hv 176 | BCMA | CD2 or TAA | TCR | CD2 or TAA | TCR | BCMA |
| Hv 177 | BCMA | CD2 or TAA | TCR | TCR | CD2 or TAA | BCMA |
| Hv 178 | BCMA | TCR | CD2 or TAA | CD2 or TAA | TCR | BCMA |
| Hv 179 | BCMA | TCR | CD2 or TAA | TCR | CD2 or TAA | BCMA |
| Hv 180 | BCMA | TCR | TCR | CD2 or TAA | CD2 or TAA | BCMA |
| Hv 181 | CD2 or TAA | BCMA | BCMA | CD2 or TAA | TCR | TCR |
| Hv 182 | CD2 or TAA | BCMA | BCMA | TCR | CD2 or TAA | TCR |
| Hv 183 | CD2 or TAA | BCMA | BCMA | TCR | TCR | CD2 or TAA |
| Hv 184 | TCR | BCMA | BCMA | CD2 or TAA | CD2 or TAA | TCR |
| Hv 185 | TCR | BCMA | BCMA | CD2 or TAA | TCR | CD2 or TAA |
| Hv 186 | TCR | BCMA | BCMA | TCR | CD2 or TAA | CD2 or TAA |
| Hv 187 | CD2 or TAA | BCMA | CD2 or TAA | BCMA | TCR | TCR |
| Hv 188 | CD2 or TAA | BCMA | TCR | BCMA | CD2 or TAA | TCR |
| Hv 189 | CD2 or TAA | BCMA | TCR | BCMA | TCR | CD2 or TAA |
| Hv 190 | TCR | BCMA | CD2 or TAA | BCMA | CD2 or TAA | TCR |
| Hv 191 | TCR | BCMA | CD2 or TAA | BCMA | TCR | CD2 or TAA |
| Hv 192 | TCR | BCMA | TCR | BCMA | CD2 or TAA | CD2 or TAA |
| Hv 193 | CD2 or TAA | BCMA | CD2 or TAA | TCR | BCMA | TCR |
| Hv 194 | CD2 or TAA | BCMA | TCR | CD2 or TAA | BCMA | TCR |
| Hv 195 | CD2 or TAA | BCMA | TCR | TCR | BCMA | CD2 or TAA |
| Hv 196 | TCR | BCMA | CD2 or TAA | CD2 or TAA | BCMA | TCR |
| Hv 197 | TCR | BCMA | CD2 or TAA | TCR | BCMA | CD2 or TAA |
| Hv 198 | TCR | BCMA | TCR | CD2 or TAA | BCMA | CD2 or TAA |
| Hv 199 | CD2 or TAA | BCMA | CD2 or TAA | TCR | TCR | BCMA |
| Hv 200 | CD2 or TAA | BCMA | TCR | CD2 or TAA | TCR | BCMA |

TABLE 10-continued

ABM Permutations in Hexavalent TBMs

TABLE 10-continued

ABM Permutations in Hexavalent TBMs

| Hexavalent Configuration | X | Y | Z | A | B | C |
|---|---|---|---|---|---|---|
| Hv 201 | CD2 or TAA | BCMA | TCR | TCR | CD2 or TAA | BCMA |
| Hv 202 | TCR | BCMA | CD2 or TAA | CD2 or TAA | TCR | BCMA |
| Hv 203 | TCR | BCMA | CD2 or TAA | TCR | CD2 or TAA | BCMA |
| Hv 204 | TCR | BCMA | TCR | CD2 or TAA | CD2 or TAA | BCMA |
| Hv 205 | CD2 or TAA | CD2 or TAA | BCMA | BCMA | TCR | TCR |
| Hv 206 | CD2 or TAA | TCR | BCMA | BCMA | CD2 or TAA | TCR |
| Hv 207 | CD2 or TAA | TCR | BCMA | BCMA | TCR | CD2 or TAA |
| Hv 208 | TCR | CD2 or TAA | BCMA | BCMA | CD2 or TAA | TCR |
| Hv 209 | TCR | CD2 or TAA | BCMA | BCMA | TCR | CD2 or TAA |
| Hv 210 | TCR | TCR | BCMA | BCMA | CD2 or TAA | CD2 or TAA |
| Hv 211 | CD2 or TAA | CD2 or TAA | BCMA | TCR | BCMA | TCR |
| Hv 212 | CD2 or TAA | TCR | BCMA | CD2 or TAA | BCMA | TCR |
| Hv 213 | CD2 or TAA | TCR | BCMA | TCR | BCMA | CD2 or TAA |
| Hv 214 | TCR | CD2 or TAA | BCMA | CD2 or TAA | BCMA | TCR |
| Hv 215 | TCR | CD2 or TAA | BCMA | TCR | BCMA | CD2 or TAA |
| Hv 216 | TCR | TCR | BCMA | CD2 or TAA | BCMA | CD2 or TAA |
| Hv 217 | CD2 or TAA | CD2 or TAA | BCMA | TCR | TCR | BCMA |
| Hv 218 | CD2 or TAA | TCR | BCMA | CD2 or TAA | TCR | BCMA |
| Hv 219 | CD2 or TAA | TCR | BCMA | TCR | CD2 or TAA | BCMA |
| Hv 220 | TCR | CD2 or TAA | BCMA | CD2 or TAA | TCR | BCMA |
| Hv 221 | TCR | CD2 or TAA | BCMA | TCR | CD2 or TAA | BCMA |
| Hv 222 | TCR | TCR | BCMA | CD2 or TAA | CD2 or TAA | BCMA |
| Hv 223 | CD2 or TAA | CD2 or TAA | TCR | BCMA | BCMA | TCR |
| Hv 224 | CD2 or TAA | TCR | CD2 or TAA | BCMA | BCMA | TCR |
| Hv 225 | CD2 or TAA | TCR | TCR | BCMA | BCMA | CD2 or TAA |
| Hv 226 | TCR | CD2 or TAA | CD2 or TAA | BCMA | BCMA | TCR |
| Hv 227 | TCR | CD2 or TAA | TCR | BCMA | BCMA | CD2 or TAA |
| Hv 228 | TCR | TCR | CD2 or TAA | BCMA | BCMA | CD2 or TAA |
| Hv 229 | CD2 or TAA | CD2 or TAA | TCR | BCMA | TCR | BCMA |
| Hv 230 | CD2 or TAA | TCR | CD2 or TAA | BCMA | TCR | BCMA |
| Hv 231 | CD2 or TAA | TCR | TCR | BCMA | CD2 or TAA | BCMA |
| Hv 232 | TCR | CD2 or TAA | CD2 or TAA | BCMA | TCR | BCMA |
| Hv 233 | TCR | CD2 or TAA | TCR | BCMA | CD2 or TAA | BCMA |
| Hv 234 | TCR | TCR | CD2 or TAA | BCMA | CD2 or TAA | BCMA |
| Hv 235 | CD2 or TAA | CD2 or TAA | TCR | TCR | BCMA | BCMA |
| Hv 236 | CD2 or TAA | TCR | CD2 or TAA | TCR | BCMA | BCMA |
| Hv 237 | CD2 or TAA | TCR | TCR | CD2 or TAA | BCMA | BCMA |
| Hv 238 | TCR | CD2 or TAA | CD2 or TAA | TCR | BCMA | BCMA |
| Hv 239 | TCR | CD2 or TAA | TCR | CD2 or TAA | BCMA | BCMA |
| Hv 240 | TCR | TCR | CD2 or TAA | CD2 or TAA | BCMA | BCMA |
| Hv 241 | BCMA | BCMA | CD2 or TAA | TCR | TCR | TCR |
| Hv 242 | BCMA | BCMA | TCR | CD2 or TAA | TCR | TCR |
| Hv 243 | BCMA | BCMA | TCR | TCR | CD2 or TAA | TCR |
| Hv 244 | BCMA | BCMA | TCR | TCR | TCR | CD2 or TAA |
| Hv 245 | BCMA | CD2 or TAA | BCMA | TCR | TCR | TCR |
| Hv 246 | BCMA | TCR | BCMA | CD2 or TAA | TCR | TCR |
| Hv 247 | BCMA | TCR | BCMA | TCR | CD2 or TAA | TCR |
| Hv 248 | BCMA | TCR | BCMA | TCR | TCR | CD2 or TAA |
| Hv 249 | BCMA | CD2 or TAA | TCR | BCMA | TCR | TCR |
| Hv 250 | BCMA | TCR | CD2 or TAA | BCMA | TCR | TCR |
| Hv 251 | BCMA | TCR | TCR | BCMA | CD2 or TAA | TCR |
| Hv 252 | BCMA | TCR | TCR | BCMA | TCR | CD2 or TAA |
| Hv 253 | BCMA | CD2 or TAA | TCR | TCR | BCMA | TCR |
| Hv 254 | BCMA | TCR | CD2 or TAA | TCR | BCMA | TCR |
| Hv 255 | BCMA | TCR | TCR | CD2 or TAA | BCMA | TCR |
| Hv 256 | BCMA | TCR | TCR | TCR | BCMA | CD2 or TAA |
| Hv 257 | BCMA | CD2 or TAA | TCR | TCR | TCR | BCMA |
| Hv 258 | BCMA | TCR | CD2 or TAA | TCR | TCR | BCMA |
| Hv 259 | BCMA | TCR | TCR | CD2 or TAA | TCR | BCMA |
| Hv 260 | BCMA | TCR | TCR | TCR | CD2 or TAA | BCMA |
| Hv 261 | CD2 or TAA | BCMA | BCMA | TCR | TCR | TCR |
| Hv 262 | TCR | BCMA | BCMA | CD2 or TAA | TCR | TCR |
| Hv 263 | TCR | BCMA | BCMA | TCR | CD2 or TAA | TCR |
| Hv 264 | TCR | BCMA | BCMA | TCR | TCR | CD2 or TAA |
| Hv 265 | CD2 or TAA | BCMA | TCR | BCMA | TCR | TCR |
| Hv 266 | TCR | BCMA | CD2 or TAA | BCMA | TCR | TCR |
| Hv 267 | TCR | BCMA | TCR | BCMA | CD2 or TAA | TCR |
| Hv 268 | TCR | BCMA | TCR | BCMA | TCR | CD2 or TAA |
| Hv 269 | CD2 or TAA | BCMA | TCR | TCR | BCMA | TCR |
| Hv 270 | TCR | BCMA | CD2 or TAA | TCR | BCMA | TCR |
| Hv 271 | TCR | BCMA | TCR | CD2 or TAA | BCMA | TCR |
| Hv 272 | TCR | BCMA | TCR | TCR | BCMA | CD2 or TAA |
| Hv 273 | CD2 or TAA | BCMA | TCR | TCR | TCR | BCMA |
| Hv 274 | TCR | BCMA | CD2 or TAA | TCR | TCR | BCMA |

TABLE 10-continued

ABM Permutations in Hexavalent TBMs

| Hexavalent Configuration | X | Y | Z | A | B | C |
|---|---|---|---|---|---|---|
| Hv 275 | TCR | BCMA | TCR | CD2 or TAA | TCR | BCMA |
| Hv 276 | TCR | BCMA | TCR | TCR | CD2 or TAA | BCMA |
| Hv 277 | CD2 or TAA | TCR | BCMA | BCMA | TCR | TCR |
| Hv 278 | TCR | CD2 or TAA | BCMA | BCMA | TCR | TCR |
| Hv 279 | TCR | TCR | BCMA | BCMA | CD2 or TAA | TCR |
| Hv 280 | TCR | TCR | BCMA | BCMA | TCR | CD2 or TAA |
| Hv 281 | CD2 or TAA | TCR | BCMA | TCR | BCMA | TCR |
| Hv 282 | TCR | CD2 or TAA | BCMA | TCR | BCMA | TCR |
| Hv 283 | TCR | TCR | BCMA | CD2 or TAA | BCMA | TCR |
| Hv 284 | TCR | TCR | BCMA | TCR | BCMA | CD2 or TAA |
| Hv 285 | CD2 or TAA | TCR | BCMA | TCR | TCR | BCMA |
| Hv 286 | TCR | CD2 or TAA | BCMA | TCR | TCR | BCMA |
| Hv 287 | TCR | TCR | BCMA | CD2 or TAA | TCR | BCMA |
| Hv 288 | TCR | TCR | BCMA | TCR | CD2 or TAA | BCMA |
| Hv 289 | CD2 or TAA | TCR | TCR | BCMA | BCMA | TCR |
| Hv 290 | TCR | CD2 or TAA | TCR | BCMA | BCMA | TCR |
| Hv 291 | TCR | TCR | CD2 or TAA | BCMA | BCMA | TCR |
| Hv 292 | TCR | TCR | TCR | BCMA | BCMA | CD2 or TAA |
| Hv 293 | CD2 or TAA | TCR | TCR | BCMA | TCR | BCMA |
| Hv 294 | TCR | CD2 or TAA | TCR | BCMA | TCR | BCMA |
| Hv 295 | TCR | TCR | CD2 or TAA | BCMA | TCR | BCMA |
| Hv 296 | TCR | TCR | TCR | BCMA | CD2 or TAA | BCMA |
| Hv 297 | CD2 or TAA | TCR | TCR | TCR | BCMA | BCMA |
| Hv 298 | TCR | CD2 or TAA | TCR | TCR | BCMA | BCMA |
| Hv 299 | TCR | TCR | CD2 or TAA | TCR | BCMA | BCMA |
| Hv 300 | TCR | TCR | TCR | CD2 or TAA | BCMA | BCMA |
| Hv 301 | BCMA | CD2 or TAA | TCR | TCR | TCR | TCR |
| Hv 302 | BCMA | TCR | CD2 or TAA | TCR | TCR | TCR |
| Hv 303 | BCMA | TCR | TCR | CD2 or TAA | TCR | TCR |
| Hv 304 | BCMA | TCR | TCR | TCR | CD2 or TAA | TCR |
| Hv 305 | BCMA | TCR | TCR | TCR | TCR | CD2 or TAA |
| Hv 306 | CD2 or TAA | BCMA | TCR | TCR | TCR | TCR |
| Hv 307 | TCR | BCMA | CD2 or TAA | TCR | TCR | TCR |
| Hv 308 | TCR | BCMA | TCR | CD2 or TAA | TCR | TCR |
| Hv 309 | TCR | BCMA | TCR | TCR | CD2 or TAA | TCR |
| Hv 310 | TCR | BCMA | TCR | TCR | TCR | CD2 or TAA |
| Hv 311 | CD2 or TAA | TCR | BCMA | TCR | TCR | TCR |

TABLE 10-continued

ABM Permutations in Hexavalent TBMs

| Hexavalent Configuration | X | Y | Z | A | B | C |
|---|---|---|---|---|---|---|
| Hv 312 | TCR | CD2 or TAA | BCMA | TCR | TCR | TCR |
| Hv 313 | TCR | TCR | BCMA | CD2 or TAA | TCR | TCR |
| Hv 314 | TCR | TCR | BCMA | TCR | CD2 or TAA | TCR |
| Hv 315 | TCR | TCR | BCMA | TCR | TCR | CD2 or TAA |
| Hv 316 | CD2 or TAA | TCR | TCR | BCMA | TCR | TCR |
| Hv 317 | TCR | CD2 or TAA | TCR | BCMA | TCR | TCR |
| Hv 318 | TCR | TCR | CD2 or TAA | BCMA | TCR | TCR |
| Hv 319 | TCR | TCR | TCR | BCMA | CD2 or TAA | TCR |
| Hv 320 | TCR | TCR | TCR | BCMA | TCR | CD2 or TAA |
| Hv 321 | CD2 or TAA | TCR | TCR | TCR | BCMA | TCR |
| Hv 322 | TCR | CD2 or TAA | TCR | TCR | BCMA | TCR |
| Hv 323 | TCR | TCR | CD2 or TAA | TCR | BCMA | TCR |
| Hv 324 | TCR | TCR | TCR | CD2 or TAA | BCMA | TCR |
| Hv 325 | TCR | TCR | TCR | TCR | BCMA | CD2 or TAA |
| Hv 326 | CD2 or TAA | TCR | TCR | TCR | TCR | BCMA |
| Hv 327 | TCR | CD2 or TAA | TCR | TCR | TCR | BCMA |
| Hv 328 | TCR | TCR | CD2 or TAA | TCR | TCR | BCMA |
| Hv 329 | TCR | TCR | TCR | CD2 or TAA | TCR | BCMA |
| Hv 330 | TCR | TCR | TCR | TCR | CD2 or TAA | BCMA |

7.5. BCMA ABMs

The MBMs (e.g., TBMs) contain an ABM (ABM1) that specifically binds to human BCMA. BCMA is a tumor necrosis family receptor (TNFR) member expressed on cells of the B-cell lineage. BCMA expression is the highest on terminally differentiated B cells that assume the long lived plasma cell fate, including plasma cells, plasmablasts and a subpopulation of activated B cells and memory B cells. BCMA is involved in mediating the survival of plasma cells for maintaining long-term humoral immunity. The expression of BCMA has been recently linked to a number of cancers, autoimmune disorders, and infectious diseases. Cancers with increased expression of BCMA include some hematological cancers, such as multiple myeloma, Hodgkin's and non-Hodgkin's lymphoma, various leukemias, and glioblastoma.

ABM1 can comprise, for example, an anti-BCMA antibody or an antigen-binding domain thereof. The anti-BCMA antibody or antigen-binding domain thereof can comprise, for example, CDR, VH, VL, or scFV sequences set forth in Tables 11A-1 to 11P (collectively "Table 11").

TABLE 11A-1

| Binder | CDR-L1 | SEQ ID NO: | CDR-L2: | SEQ ID NO: | CDR-L3 | SEQ ID NO: |
|--------|--------|------------|---------|------------|--------|------------|
| AB1/AB2 Family Light Chain CDR Consensus sequences | | | | | | |
| C1 (AB1/AB2 consensus-Kabat) | RASQSISSYLN | 79 | AASSLQS | 82 | QQSYSXPLT (X = S or T) | 84 |
| C2 (AB1/AB2 family consensus-Kabat) | RASQSISSYLN | 79 | AASSLQS | 82 | QQSYX$_1$X$_2$PX$_3$T (X$_1$ = S, G, D, Y, or A; X$_2$ = S, T, or A; X$_3$ = P or L) | 85 |
| C3 (AB1/AB2 consensus-Chothia) | SQSISSY | 80 | AAS | 83 | SYSXPL (X = S or T) | 86 |
| C4 (AB1/AB2 family consensus-Chothia) | SQSISSY | 80 | AAS | 83 | SYX$_1$X$_2$PX$_3$ (X$_1$ = S, G, D, Y, OR A; X$_2$ = S, T, OR A; X$_3$ = P OR L) | 87 |
| C5 (AB1/AB2 consensus-IMGT) | QSISSY | 81 | AAS | 83 | QQSYSXPLT (X = S OR T) | 84 |
| C6 (AB1/AB2 family consensus-IMGT) | QSISSY | 81 | AAS | 83 | QQSYX$_1$X$_2$PX$_3$T (X$_1$ = S, G, D, Y, OR A; X$_2$ = S, T, OR A; X$_3$ = P OR L) | 85 |
| C7 (AB1/AB2 consensus-Kabat + Chothia) | RASQSISSYLN | 79 | AASSLQS | 82 | QQSYSXPLT (X = S OR T) | 84 |
| C8 (AB1/AB2 family consensus-Kabat + Chothia) | RASQSISSYLN | 79 | AASSLQS | 82 | QQSYX$_1$X$_2$PX$_3$T (X$_1$ = S, G, D, Y, OR A; X$_2$ = S, T, OR A; X$_3$ = P OR L) | 85 |
| C9 (AB1/AB2 consensus-Kabat + IMGT) | RASQSISSYLN | 79 | AASSLQS | 82 | QQSYSXPLT (X = S OR T) | 84 |
| C10 (AB1/AB2 family consensus-Kabat + IMGT) | RASQSISSYLN | 79 | AASSLQS | 82 | QQSYX$_1$X$_2$PX$_3$T (X$_1$ = S, G, D, Y, OR A; X$_2$ = S, T, OR A; X$_3$ = P OR L) | 85 |
| C11 (AB1/AB2 consensus-Chothia + IMGT) | SQSISSY | 80 | AAS | 83 | QQSYSXPLT (X = S or T) | 84 |
| C12 (AB1/AB2 family consensus-Chothia + IMGT) | SQSISSY | 80 | AAS | 83 | QQSYX$_1$X$_2$PX$_3$T (X$_1$ = S, G, D, Y, OR A; X$_2$ = S, T, OR A; X$_3$ = P OR L) | 85 |

TABLE 11A-2

AB1/AB2 Family Heavy Chain CDR Consensus sequences

| Binder | CDR-H1 | SEQ ID NO: | CDR-H2: | SEQ ID NO: | CDR-H3 | SEQ ID NO: |
|---|---|---|---|---|---|---|
| C1 (AB1/AB2 consensus-Kabat) | SYAMS | 88 | AISX$_1$SGGX$_2$X$_3$X$_4$YADS VKG (X$_1$ = G or E; X$_2$ = S or R; X$_3$ = T or A; X$_4$ = Y or A) | 92 | REWWYDDWYLDY | 98 |
| C2 (AB1/AB2 family consensus-Kabat) | SYAMS | 88 | AISX$_1$X$_2$GX$_3$X$_4$X$_5$X$_6$YAD SVKG (X$_1$ = G, E, or A; X$_2$ = S, A, H, or E; X$_3$ = G, D, E ,H, R, or A; X$_4$ = S, R, V, T, Y; X$_5$ = T, A, E, H, or R; X$_6$ = Y, A, or S) | 93 | REWWYDDWYLDY | 98 |
| C3 (AB1/AB2 consensus-Chothia) | GFTFSSY | 89 | SX$_1$SGGX$_2$ (X$_1$ = G or E; X$_2$ = S or R) | 94 | REWWYDDWYLDY | 98 |
| C4 (AB1/AB2 family consensus-Chothia) | GFTFSSY | 89 | SX$_1$X$_2$GX$_3$X$_4$ (X$_1$ = G, E, or A; X$_2$ = S, A, H, or E; X$_3$ = G, D, E ,H, R, or A; X$_4$ = S, R, V, T, Y) | 95 | REWWYDDWYLDY | 98 |
| C5 (AB1/AB2 consensus-IMGT) | GFTFSSYA | 90 | ISX$_1$SGGX$_2$X$_3$ (X$_1$ = G or E; X$_2$ = S or R; X$_3$ = T or A) | 96 | ARREWWYDDWYL DY | 99 |
| C6 (AB1/AB2 family consensus-IMGT) | GFTFSSYA | 90 | ISX$_1$X$_2$GX$_3$X$_4$X$_5$ (X$_1$ = G, E, or A; X$_2$ = S, A, H, or E; X$_3$ = G, D, E ,H, R, or A; X$_4$ = S, R, V, T, Y; X$_5$ = T, A, E, H, or R) | 97 | ARREWWYDDWYL DY | 99 |
| C7 (AB1/AB2 consensus-Kabat + Chothia) | GFTFSSYAMS | 91 | AISX$_1$SGGX$_2$X$_3$X$_4$YADS VKG (X$_1$ = G or E; X$_2$ = S or R; X$_3$ = T or A; X$_4$ = Y or A) | 92 | REWWYDDWYLDY | 98 |
| C8 (AB1/AB2 family consensus-Kabat + Chothia) | GFTFSSYAMS | 91 | AISX$_1$X$_2$GX$_3$X$_4$X$_5$X$_6$YAD SVKG (X$_1$ = G, E, or A; X$_2$ = S, A, H, or E; X$_3$ = G, D, E ,H, R, or A; X$_4$ = S, R, V, T, Y; X$_5$ = T, A, E, H, or R; X$_6$ = Y, A, or S) | 93 | REWWYDDWYLDY | 98 |
| C9 (AB1/AB2 consensus-Kabat + IMGT) | GFTFSSYAMS | 91 | AISX$_1$SGGX$_2$X$_3$X$_4$YADS VKG (X$_1$ = G or E; X$_2$ = S or R; X$_3$ = T or A; X$_4$ = Y orA) | 92 | ARREWWYDDWYL DY | 99 |
| C10 (AB1/AB2 family consensus-Kabat + IMGT) | GFTFSSYAMS | 91 | AISX$_1$X$_2$GX$_3$X$_4$X$_5$X$_6$YAD SVKG (X$_1$ = G, E, or A; X$_2$ = S, A, H, or E; X$_3$ = G, D, E ,H, R, or A; X$_4$ = S, R, V, T, Y; X$_5$ = T, A, E, H, or R; X$_6$ = Y, A, or S) | 93 | ARREWWYDDWYL DY | 99 |
| C11 (AB1/AB2 consensus-Chothia + IMGT) | GFTFSSYA | 90 | ISX$_1$SGGX$_2$X$_3$ (X$_1$ = G or E, X$_2$ = S or R; X$_3$ = T or A) | 96 | ARREWWYDDWYL DY | 99 |

TABLE 11A-2-continued

AB1/AB2 Family Heavy Chain CDR Consensus sequences

| Binder | CDR-H1 | SEQ ID NO: | CDR-H2: | SEQ ID NO: | CDR-H3 | SEQ ID NO: |
|---|---|---|---|---|---|---|
| C12 (AB1/AB2 family consensus-Chothia + IMGT) | GFTFSSYA | 90 | ISX$_1$X$_2$GX$_3$X$_4$X$_5$ (X$_1$ = G, E, or A; X$_2$ = S, A, H, or E; X$_3$ = G, D, E ,H, R, or A; X$_4$ = S, R, V, T, Y; X$_5$ = T, A, E, H, or R) | 97 | ARREWWYDDWYLDY | 99 |

TABLE 11B-1

AB3 Family Light Chain CDR Consensus sequences

| Binder | CDR-L1 | SEQ ID NO: | CDR-L2: | SEQ ID NO: | CDR-L3 | SEQ ID NO: |
|---|---|---|---|---|---|---|
| C13 (AB3/PI-61 consensus-Kabat) | TGTSSDVGGYNYVS | 100 | DVSNRX$_1$X$_2$ (X$_1$ = L or P; X$_2$ = R or S) | 103 | SSYTSSSXLYV (X = A or T) | 110 |
| C14 (AB3 family consensus-Kabat) | TGTSSDVGGYNYVS | 100 | X$_1$VSNRX$_2$X$_3$ (X$_1$ = D or E; X$_2$ = L, P, or A; X$_3$ = R, S, G, or W) | 104 | SSYTSSSXLYV (X = A or T) | 110 |
| C15 (AB3/PI-61 consensus-Chothia) | TSSDVGGYNY | 101 | DVS | 105 | YTSSSXLY (X = A or T) | 111 |
| C16 (AB3 family consensus-Chothia) | TSSDVGGYNY | 101 | XVS (X = D or E) | 106 | YTSSSXLY (X = A or T) | 111 |
| C17 (AB3/PI-61 consensus-IMGT with expanded CDR-L2) | SSDVGGYNY | 102 | DVSNRX$_1$X$_2$GVS (X$_1$ = L OR P; X$_2$ = R OR S) | 107 | SSYTSSSXLYV (X = A or T) | 110 |
| C18 (AB3 family consensus-IMGT with expanded CDR-L2) | SSDVGGYNY | 102 | X$_1$VSNRX$_2$X$_3$GVS (X$_1$ = D or E; X$_2$ = L, P, or A; X$_3$ = R, S, G, or W) | 108 | SSYTSSSXLYV (X = A or T) | 110 |
| C19 (AB3/PI-61 consensus-Kabat + Chothia) | TGTSSDVGGYNYVS | 100 | DVSNRX$_1$X$_2$ (X$_1$ = L OR P; X$_2$ = R OR S) | 103 | SSYTSSSXLYV (X = A or T) | 110 |
| C20 (AB3 family consensus-Kabat + Chothia) | TGTSSDVGGYNYVS | 100 | X$_1$VSNRX$_2$X$_3$ (X$_1$ = D or E; X$_2$ = L, P, or A; X$_3$ = R, S, G, or W) | 104 | SSYTSSSXLYV (X = A or T) | 110 |
| C21 (AB3/PI-61 consensus-Kabat + IMGT) | TGTSSDVGGYNYVS | 100 | DVSNRX$_1$X$_2$ (X$_1$ = L OR P; X$_2$ = R OR S) | 103 | SSYTSSSXLYV (X = A or T) | 110 |
| C22 (AB3 family consensus-Kabat + IMGT) | TGTSSDVGGYNYVS | 100 | X$_1$VSNRX$_2$X$_3$ (X$_1$ = D or E; X$_2$ = L, P, or A; X$_3$ = R, S, G, or W) | 104 | SSYTSSSXLYV (X = A or T) | 110 |

TABLE 11B-1-continued

| | | SEQ ID NO: | | SEQ ID NO: | | SEQ ID NO: |
|---|---|---|---|---|---|---|
| Binder | CDR-L1 | | CDR-L2: | | CDR-L3 | |
| C23 (AB3/PI-61 consensus-Chothia + IMGT with expanded CDR-L2) | TSSDVGGYNY | 101 | DVSNRX$_1$X$_2$GVS (X$_1$ = L or P; X$_2$ = R or S) | 107 | SSYTSSSXLYV (X = A or T) | 110 |
| C24 (AB3 family consensus-Chothia + IMGT with expanded CDR-L2) | TSSDVGGYNY | 101 | X$_1$VSNRX$_2$X$_3$GVS (X$_1$ = D or E; X$_2$ = L, P, or A; X$_3$ = R, S, G, or W) | 108 | SSYTSSSXLYV (X = A or T) | 110 |
| C25 (AB3/PI-61 consensus-IMGT) | SSDVGGYNY | 102 | DVS | 105 | SSYTSSSXLYV (X = A or T) | 110 |
| C26 (AB3 family consensus-IMGT) | SSDVGGYNY | 102 | X$_1$VS (X$_1$ = D or E) | 109 | SSYTSSSXLYV (X = A or T) | 110 |
| C27 (AB3/PI-61 consensus-Chothia + IMGT) | TSSDVGGYNY | 101 | DVS | 105 | SSYTSSSXLYV (X = A or T) | 110 |
| C28 (AB3 family consensus-Chothia + IMGT) | TSSDVGGYNY | 101 | X$_1$VS (X$_1$ = D or E) | 109 | SSYTSSSXLYV (X = A or T) | 110 |

TABLE 11B-2

AB3 Family Heavy Chain CDR Consensus sequences

| | | SEQ ID NO: | | SEQ ID NO: | | SEQ ID NO: |
|---|---|---|---|---|---|---|
| Binder | CDR-H1 | | CDR-H2: | | CDR-H3 | |
| C13 (AB3/PI-61 consensus-Kabat) | SYGMH | 112 | VISYXGSNKYYADSV KG (X = T or D) | 116 | SGYALHDDYYGLD V | 122 |
| C14 (AB3 family consensus-Kabat) | SYGMH | 112 | VISYX$_1$X$_2$X$_3$X$_4$KYYAD SVKG (X$_1$ = H, K, T, R, D, N, S; X$_2$ = G,D, or E; X$_3$ = S, T, F, A, L; X$_4$= H, N or K) | 117 | SGYX$_1$X$_2$X3X4X$_5$X$_6$X$_7$ x$_8$x$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D ;X$_8$ = G or P; X$_9$ = L, Q, V, or T) | 123 |
| C15 (AB3/PI-61 consensus-Chothia) | GFTXSSY (X = V or F) | 113 | SYXGSN (X = T or D) | 118 | SGYALHDDYYGLD V | 122 |

TABLE 11B-2-continued

AB3 Family Heavy Chain CDR Consensus sequences

| Binder | CDR-H1 | SEQ ID NO: | CDR-H2: | SEQ ID NO: | CDR-H3 | SEQ ID NO: |
|---|---|---|---|---|---|---|
| C16 (AB3 family consensus-Chothia) | GFTXSSY (X = V or F) | 113 | SYX$_1$X$_2$X$_3$X$_4$KG (X$_1$ = H, K, T, R, D, N, S; X$_2$ = G,D, or E; X$_3$ = S, T, F, A, L; X$_4$ = H, N or K) | 119 | SGYX$_1$X$_2$X$_3$X$_4$X$_5$X$_6$X$_7$ x$_8$x$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 123 |
| C17 (AB3/PI-61 consensus-IMGT) | GFTXSSYG (X = V or F) | 114 | ISYXGSNK (X = T or D) | 120 | GGSGYALHDDYYG LDV | 124 |
| C18 (AB3 family consensus-IMGT) | GFTXSSYG (X = V or F) | 114 | ISYX$_1$X$_2$X$_3$X$_4$K (X$_1$ = H, K, T, R, D, N, S; X$_2$ = G, D, or E; X$_3$ = S, T, F, A, L; X$_4$ = H, N or K) | 121 | GGSGYX$_1$X$_2$X$_3$X$_4$X$_5$X$_6$X$_7$X$_8$X$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 125 |
| C19 (AB3/PI-61 consensus- Kabat + Chothia) | GFTXSSYGM H (X = V or F) | 115 | VISYXGSNKYYADSV KG (X = T or D) | 116 | SGYALHDDYYGLD V | 122 |
| C20 (AB3 family consensus- Kabat + Chothia) | GFTXSSYGM H (X = V or F) | 115 | VISYX$_1$X$_2$X$_3$X$_4$KYYAD SVKG (X$_1$ = H, K, T, R, D, N, S; X$_2$ = G, D, or E; X$_3$ = S, T, F, A, L; X$_4$ = H, N or K) | 117 | SGYX$_1$X$_2$X$_3$X$_4$X$_5$X$_6$X$_7$ x$_8$x$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D ;X$_8$ = G or P; X$_9$ = L, Q, V, or T) | 123 |
| C21 (AB3/PI-61 consensus- Kabat + IMGT) | GFTXSSYGM H (X = V or F) | 115 | VISYXGSNKYYADSV KG (X = T or D) | 116 | GGSGYALHDDYYG LDV | 124 |
| C22 (AB3 family consensus- Kabat + IMGT) | GFTXSSYGM H (X = V or F) | 115 | VISYX$_1$X$_2$X$_3$X$_4$KYYAD SVKG (X$_1$ = H, K, T, R, D, N, S; X$_2$ = G, D, or E; X$_3$ = S, T, F, A, L; X$_4$ = H, N or K) | 117 | GGSGYX$_1$X$_2$X$_3$X$_4$X$_5$X$_6$ X$_7$X$_8$X$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 125 |
| C23 (AB3/PI-61 consensus-Chothia + IMGT) | GFTXSSYG (X = V or F) | 114 | ISYXGSNK (X = T or D) | 120 | GGSGYALHDDYYG LDV | 124 |
| C24 (AB3 family consensus-Chothia + IMGT) | GFTXSSYG (X = V or F) | 114 | ISYX$_1$X$_2$X$_3$X$_4$K (X$_1$ = H, K, T, R, D, N, S; X$_2$ = G, D, or E; X$_3$ = S, T, F, A, L; X$_4$ = H, N or K) | 121 | GGSGYX$_1$X$_2$X$_3$X$_4$X$_5$X$_6$ X$_7$X$_8$X$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 125 |

TABLE 11B-2-continued

AB3 Family Heavy Chain CDR Consensus sequences

| Binder | CDR-H1 | SEQ ID NO: | CDR-H2: | SEQ ID NO: | CDR-H3 | SEQ ID NO: |
|---|---|---|---|---|---|---|
| C25 (AB3/PI-61 consensus-IMGT) | GFTXSSYG (X = V or F) | 114 | ISYXGSNK (X = T or D) | 120 | GGSGYALHDDYYG LDV | 124 |
| C26 (AB3 family consensus-IMGT) | GFTXSSYG (X = V or F) | 114 | ISYX$_1$X$_2$X$_3$X$_4$K (X$_1$ = H, K, T, R, D, N, S; X$_2$ = G, D, or E; X$_3$ = S, T, F, A, L; X$_4$ = H, N or K) | 121 | GGSGYX$_1$X$_2$X$_3$X$_4$X$_5$X$_6$ X$_7$X$_8$X$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 125 |
| C27 (AB3/PI-61 consensus-Chothia + IMGT) | GFTXSSYG (X = V or F) | 114 | ISYXGSNK (X = T or D) | 120 | GGSGYALHDDYYG LDV | 124 |
| C28 (AB3 family consensus-Chothia + IMGT) | GFTXSSYG (X = V or F) | 114 | ISYX$_1$X$_2$X$_3$X$_4$K (X$_1$ = H, K, T, R, D, N, S; X$_2$ = G, D, or E; X$_3$ = S, T, F, A, L; X$_4$ = H, N or K) | 121 | GGSGYX$_1$X$_2$X$_3$X$_4$X$_5$X$_6$ X$_7$X$_8$X$_9$DV (X$_1$ = A, N, E; X$_2$ = L, F, V, or Y; X$_3$ = H, Q, R, or D; X$_4$ = D, E, G, or Q; X$_5$ = D, Q, or F; X$_6$ = Y or Q; X$_7$ = Y, K, or D; X$_8$ = G or P; X$_9$ = L, Q, V, or T) | 125 |

TABLE 11C-1

AB1/AB2 family BCMA Binders-Light Chain CDR sequences according to Kabat numbering scheme

| Binder | CDR-L1 | SEQ ID NO: | CDR-L2: | SEQ ID NO: | CDR-L3 | SEQ ID NO: |
|---|---|---|---|---|---|---|
| AB1 | RASQSISSYLN | 79 | AASSLQS | 82 | QQSYSSPLT | 126 |
| AB2 | RASQSISSYLN | 79 | AASSLQS | 82 | QQSYSTPLT | 127 |
| R1F2 | RASQSISSYLN | 79 | AASSLQS | 82 | QQSYSTPLT | 127 |
| PALF03 | RASQSISSYLN | 79 | AASSLQS | 82 | QQSYGSPPT | 128 |
| PALF04 | RASQSISSYLN | 79 | AASSLQS | 82 | QQSYDSPLT | 129 |
| PALF05 | RASQSISSYLN | 79 | AASSLQS | 82 | QQSYYSPLT | 130 |
| PALF06 | RASQSISSYLN | 79 | AASSLQS | 82 | QQSYYAPLT | 131 |
| PALF07 | RASQSISSYLN | 79 | AASSLQS | 82 | QQSYASPLT | 132 |
| PALF08 | RASQSISSYLN | 79 | AASSLQS | 82 | QQSYGSPLT | 133 |
| PALF09 | RASQSISSYLN | 79 | AASSLQS | 82 | QQSYDAPLT | 134 |
| PALF12 | RASQSISSYLN | 79 | AASSLQS | 82 | QQSYSTPLT | 127 |
| PALF13 | RASQSISSYLN | 79 | AASSLQS | 82 | QQSYSTPLT | 127 |
| PALF14 | RASQSISSYLN | 79 | AASSLQS | 82 | QQSYSTPLT | 127 |
| PALF15 | RASQSISSYLN | 79 | AASSLQS | 82 | QQSYSTPLT | 127 |
| PALF16 | RASQSISSYLN | 79 | AASSLQS | 82 | QQSYSTPLT | 127 |
| PALF17 | RASQSISSYLN | 79 | AASSLQS | 82 | QQSYSTPLT | 127 |

TABLE 11C-1-continued

AB1/AB2 family BCMA Binders-Light Chain CDR sequences according to Kabat numbering scheme

| Binder | CDR-L1 | SEQ ID NO: | CDR-L2: | SEQ ID NO: | CDR-L3 | SEQ ID NO: |
|---|---|---|---|---|---|---|
| PALF18 | RASQSISSYLN | 79 | AASSLQS | 82 | QQSYSTPLT | 127 |
| PALF19 | RASQSISSYLN | 79 | AASSLQS | 82 | QQSYSTPLT | 127 |
| PALF20 | RASQSISSYLN | 79 | AASSLQS | 82 | QQSYSTPLT | 127 |

TABLE 11C-2

AB1/AB2 family BCMA Binders- Heavy Chain CDR sequences according to Kabat numbering scheme

| Binder | CDR-H1 | SEQ ID NO: | CDR-H2: | SEQ ID NO: | CDR-H3 | SEQ ID NO: |
|---|---|---|---|---|---|---|
| AB1 | SYAMS | 88 | AISGSGGSTYYADSVKG | 135 | REWWYDDWYLDY | 98 |
| AB2 | SYAMS | 88 | AISESGGRAAYADSVKG | 136 | REWWYDDWYLDY | 98 |
| R1F2 | SYAMS | 88 | AISGSGGSTYYADSVKG | 135 | REWWYDDWYLDY | 98 |
| PALF03 | SYAMS | 88 | AISGSGGSTYYADSVKG | 135 | REWWYDDWYLDY | 98 |
| PALF04 | SYAMS | 88 | AISGSGGSTYYADSVKG | 135 | REWWYDDWYLDY | 98 |
| PALF05 | SYAMS | 88 | AISGSGGSTYYADSVKG | 135 | REWWYDDWYLDY | 98 |
| PALF06 | SYAMS | 88 | AISGSGGSTYYADSVKG | 135 | REWWYDDWYLDY | 98 |
| PALF07 | SYAMS | 88 | AISGSGGSTYYADSVKG | 135 | REWWYDDWYLDY | 98 |
| PALF08 | SYAMS | 88 | AISGSGGSTYYADSVKG | 135 | REWWYDDWYLDY | 98 |
| PALF09 | SYAMS | 88 | AISGSGGSTYYADSVKG | 135 | REWWYDDWYLDY | 98 |
| PALF12 | SYAMS | 88 | AISGSGGRAAYADSVKG | 137 | REWWYDDWYLDY | 98 |
| PALF13 | SYAMS | 88 | AISESGDVEAYADSVKG | 138 | REWWYDDWYLDY | 98 |
| PALF14 | SYAMS | 88 | AISEAGETTSYADSVKG | 139 | REWWYDDWYLDY | 98 |
| PALF15 | SYAMS | 88 | AISEHGHYTSYADSVKG | 140 | REWWYDDWYLDY | 98 |
| PALF16 | SYAMS | 88 | AISGSGHTAAYADSVKG | 141 | REWWYDDWYLDY | 98 |
| PALF17 | SYAMS | 88 | AISGSGRTHAYADSVKG | 142 | REWWYDDWYLDY | 98 |
| PALF18 | SYAMS | 88 | AISAEGGVRAYADSVKG | 143 | REWWYDDWYLDY | 98 |
| PALF19 | SYAMS | 88 | AISGSGGTTAYADSVKG | 144 | REWWYDDWYLDY | 98 |

TABLE 11C-2-continued

AB1/AB2 family BCMA Binders- Heavy Chain CDR sequences according to Kabat numbering scheme

| Binder | CDR-H1 | SEQ ID NO: | CDR-H2: | SEQ ID NO: | CDR-H3 | SEQ ID NO: |
|---|---|---|---|---|---|---|
| PALF20 | SYAMS | 88 | AISGSGATTAYADSVKG | 145 | REWWYDDWYLDY | 98 |

TABLE 11D-1

AB1/AB2 family BCMA Binders- Light Chain CDR sequences according to Chothia numbering scheme

| Binder | CDR-L1 | SEQ ID NO: | CDR-L2: | SEQ ID NO: | CDR-L3 | SEQ ID NO: |
|---|---|---|---|---|---|---|
| AB1 | SQSISSY | 80 | AAS | 83 | SYSSPL | 146 |
| AB2 | SQSISSY | 80 | AAS | 83 | SYSTPL | 147 |
| R1F2 | SQSISSY | 80 | AAS | 83 | SYSTPL | 147 |
| PALF03 | SQSISSY | 80 | AAS | 83 | SYGSPP | 148 |
| PALF04 | SQSISSY | 80 | AAS | 83 | SYDSPL | 149 |
| PALF05 | SQSISSY | 80 | AAS | 83 | SYYSPL | 150 |
| PALF06 | SQSISSY | 80 | AAS | 83 | SYYAPL | 151 |
| PALF07 | SQSISSY | 80 | AAS | 83 | SYASPL | 152 |
| PALF08 | SQSISSY | 80 | AAS | 83 | SYGSPL | 153 |
| PALF09 | SQSISSY | 80 | AAS | 83 | SYDAPL | 154 |
| PALF12 | SQSISSY | 80 | AAS | 83 | SYSTPL | 147 |
| PALF13 | SQSISSY | 80 | AAS | 83 | SYSTPL | 147 |
| PALF14 | SQSISSY | 80 | AAS | 83 | SYSTPL | 147 |
| PALF15 | SQSISSY | 80 | AAS | 83 | SYSTPL | 147 |
| PALF16 | SQSISSY | 80 | AAS | 83 | SYSTPL | 147 |
| PALF17 | SQSISSY | 80 | AAS | 83 | SYSTPL | 147 |
| PALF18 | SQSISSY | 80 | AAS | 83 | SYSTPL | 147 |
| PALF19 | SQSISSY | 80 | AAS | 83 | SYSTPL | 147 |
| PALF20 | SQSISSY | 80 | AAS | 83 | SYSTPL | 147 |

TABLE 11D-2

AB1/AB2 family BCMA Binders-Heavy Chain CDR sequences according to
Chothia numbering scheme

| Binder | CDR-H1 | SEQ ID NO: | CDR-H2: | SEQ ID NO: | CDR-H3 | SEQ ID NO: |
|--------|--------|-----------|---------|-----------|--------|-----------|
| AB1 | GFTFSSY | 89 | SGSGGS | 155 | REWWYDDWYLDY | 98 |
| AB2 | GFTFSSY | 89 | SESGGR | 156 | REWWYDDWYLDY | 98 |
| R1F2 | GFTFSSY | 89 | SGSGGS | 155 | REWWYDDWYLDY | 98 |
| PALF03 | GFTFSSY | 89 | SGSGGS | 155 | REWWYDDWYLDY | 98 |
| PALF04 | GFTFSSY | 89 | SGSGGS | 155 | REWWYDDWYLDY | 98 |
| PALF05 | GFTFSSY | 89 | SGSGGS | 155 | REWWYDDWYLDY | 98 |
| PALF06 | GFTFSSY | 89 | SGSGGS | 155 | REWWYDDWYLDY | 98 |
| PALF07 | GFTFSSY | 89 | SGSGGS | 155 | REWWYDDWYLDY | 98 |
| PALF08 | GFTFSSY | 89 | SGSGGS | 155 | REWWYDDWYLDY | 98 |
| PALF09 | GFTFSSY | 89 | SGSGGS | 155 | REWWYDDWYLDY | 98 |
| PALF12 | GFTFSSY | 89 | SGSGGR | 157 | REWWYDDWYLDY | 98 |
| PALF13 | GFTFSSY | 89 | SESGDV | 158 | REWWYDDWYLDY | 98 |
| PALF14 | GFTFSSY | 89 | SESGDV | 158 | REWWYDDWYLDY | 98 |
| PALF15 | GFTFSSY | 89 | SEHGHY | 159 | REWWYDDWYLDY | 98 |
| PALF16 | GFTFSSY | 89 | SGSGHT | 160 | REWWYDDWYLDY | 98 |
| PALF17 | GFTFSSY | 89 | SGSGRT | 161 | REWWYDDWYLDY | 98 |
| PALF18 | GFTFSSY | 89 | SAEGGV | 162 | REWWYDDWYLDY | 98 |
| PALF19 | GFTFSSY | 89 | SGSGGT | 163 | REWWYDDWYLDY | 98 |
| PALF20 | GFTFSSY | 89 | SGSGAT | 164 | REWWYDDWYLDY | 98 |

TABLE 11E-1

AB1/AB2 family BCMA Binders-Light Chain CDR sequences according to
IMGT numbering scheme

| Binder | CDR-L1 | SEQ ID NO: | CDR-L2: | SEQ ID NO: | CDR-L3 | SEQ ID NO: |
|--------|--------|-----------|---------|-----------|--------|-----------|
| AB1 | QSISSY | 81 | AAS | 83 | QQSYSSPLT | 126 |
| AB2 | QSISSY | 81 | AAS | 83 | QQSYSTPLT | 127 |
| R1F2 | QSISSY | 81 | AAS | 83 | QQSYSTPLT | 127 |
| PALF03 | QSISSY | 81 | AAS | 83 | QQSYGSPPT | 128 |
| PALF04 | QSISSY | 81 | AAS | 83 | QQSYDSPLT | 129 |
| PALF05 | QSISSY | 81 | AAS | 83 | QQSYYSPLT | 130 |
| PALF06 | QSISSY | 81 | AAS | 83 | QQSYYAPLT | 131 |
| PALF07 | QSISSY | 81 | AAS | 83 | QQSYASPLT | 132 |
| PALF08 | QSISSY | 81 | AAS | 83 | QQSYGSPLT | 133 |
| PALF09 | QSISSY | 81 | AAS | 83 | QQSYDAPLT | 134 |
| PALF12 | QSISSY | 81 | AAS | 83 | QQSYSTPLT | 127 |
| PALF13 | QSISSY | 81 | AAS | 83 | QQSYSTPLT | 127 |

TABLE 11E-1-continued

AB1/AB2 family BCMA Binders-Light Chain CDR sequences according to IMGT numbering scheme

| Binder | CDR-L1 | SEQ ID NO: | CDR-L2: | SEQ ID NO: | CDR-L3 | SEQ ID NO: |
|---|---|---|---|---|---|---|
| PALF14 | QSISSY | 81 | AAS | 83 | QQSYSTPLT | 127 |
| PALF15 | QSISSY | 81 | AAS | 83 | QQSYSTPLT | 127 |
| PALF16 | QSISSY | 81 | AAS | 83 | QQSYSTPLT | 127 |
| PALF17 | QSISSY | 81 | AAS | 83 | QQSYSTPLT | 127 |
| PALF18 | QSISSY | 81 | AAS | 83 | QQSYSTPLT | 127 |
| PALF19 | QSISSY | 81 | AAS | 83 | QQSYSTPLT | 127 |
| PALF20 | QSISSY | 81 | AAS | 83 | QQSYSTPLT | 127 |

TABLE 11E-2

AB1/AB2 family BCMA Binders- Heavy Chain CDR sequences according to IMGT numbering scheme

| Binder | CDR-H1 | SEQ ID NO: | CDR-H2: | SEQ ID NO: | CDR-H3 | SEQ ID NO: |
|---|---|---|---|---|---|---|
| AB1 | GFTFSSYA | 90 | ISGSGGST | 165 | ARREWWYDDWYL DY | 99 |
| AB2 | GFTFSSYA | 90 | ISESGGRA | 166 | ARREWWYDDWYL DY | 99 |
| R1F2 | GFTFSSYA | 90 | ISGSGGST | 165 | ARREWWYDDWYL DY | 99 |
| PALF03 | GFTFSSYA | 90 | ISGSGGST | 165 | ARREWWYDDWYL DY | 99 |
| PALF04 | GFTFSSYA | 90 | ISGSGGST | 165 | ARREWWYDDWYL DY | 99 |
| PALF05 | GFTFSSYA | 90 | ISGSGGST | 165 | ARREWWYDDWYL DY | 99 |
| PALF06 | GFTFSSYA | 90 | ISGSGGST | 165 | ARREWWYDDWYL DY | 99 |
| PALF07 | GFTFSSYA | 90 | ISGSGGST | 165 | ARREWWYDDWYL DY | 99 |
| PALF08 | GFTFSSYA | 90 | ISGSGGST | 165 | ARREWWYDDWYL DY | 99 |
| PALF09 | GFTFSSYA | 90 | ISGSGGST | 165 | ARREWWYDDWYL DY | 99 |
| PALF12 | GFTFSSYA | 90 | ISGSGGRA | 167 | ARREWWYDDWYL DY | 99 |
| PALF13 | GFTFSSYA | 90 | ISESGDVE | 168 | ARREWWYDDWYL DY | 99 |
| PALF14 | GFTFSSYA | 90 | ISESGDVE | 168 | ARREWWYDDWYL DY | 99 |
| PALF15 | GFTFSSYA | 90 | ISEHGHYT | 169 | ARREWWYDDWYL DY | 99 |
| PALF16 | GFTFSSYA | 90 | ISGSGHTA | 170 | ARREWWYDDWYL DY | 99 |
| PALF17 | GFTFSSYA | 90 | ISGSGRTH | 171 | ARREWWYDDWYL DY | 99 |

TABLE 11E-2-continued

AB1/AB2 family BCMA Binders- Heavy Chain CDR sequences according to IMGT numbering scheme

| Binder | CDR-H1 | SEQ ID NO: | CDR-H2: | SEQ ID NO: | CDR-H3 | SEQ ID NO: |
|---|---|---|---|---|---|---|
| PALF18 | GFTFSSYA | 90 | ISAEGGVR | 172 | ARREWWYDDWYL DY | 99 |
| PALF19 | GFTFSSYA | 90 | ISGSGGTT | 173 | ARREWWYDDWYL DY | 99 |
| PALF20 | GFTFSSYA | 90 | ISGSGATT | 174 | ARREWWYDDWYL DY | 99 |

TABLE 11F-1

AB1/AB2 family BCMA Binders- Light Chain CDR sequences according to combination of Kabat and Chothia numbering schemes

| Binder | CDR-L1 | SEQ ID NO: | CDR-L2: | SEQ ID NO: | CDR-L3 | SEQ ID NO: |
|---|---|---|---|---|---|---|
| AB1 | RASQSISSYLN | 79 | AASSLQS | 82 | QQSYSSPLT | 126 |
| AB2 | RASQSISSYLN | 79 | AASSLQS | 82 | QQSYSTPLT | 127 |
| R1F2 | RASQSISSYLN | 79 | AASSLQS | 82 | QQSYSTPLT | 127 |
| PALF03 | RASQSISSYLN | 79 | AASSLQS | 82 | QQSYGSPPT | 128 |
| PALF04 | RASQSISSYLN | 79 | AASSLQS | 82 | QQSYDSPLT | 129 |
| PALF05 | RASQSISSYLN | 79 | AASSLQS | 82 | QQSYYSPLT | 130 |
| PALF06 | RASQSISSYLN | 79 | AASSLQS | 82 | QQSYYAPLT | 131 |
| PALF07 | RASQSISSYLN | 79 | AASSLQS | 82 | QQSYASPLT | 132 |
| PALF08 | RASQSISSYLN | 79 | AASSLQS | 82 | QQSYGSPLT | 133 |
| PALF09 | RASQSISSYLN | 79 | AASSLQS | 82 | QQSYDAPLT | 134 |
| PALF12 | RASQSISSYLN | 79 | AASSLQS | 82 | QQSYSTPLT | 127 |
| PALF13 | RASQSISSYLN | 79 | AASSLQS | 82 | QQSYSTPLT | 127 |
| PALF14 | RASQSISSYLN | 79 | AASSLQS | 82 | QQSYSTPLT | 127 |
| PALF15 | RASQSISSYLN | 79 | AASSLQS | 82 | QQSYSTPLT | 127 |

TABLE 11F-1-continued

AB1/AB2 family BCMA Binders- Light Chain CDR
sequences according to combination of Kabat
and Chothia numbering schemes

| Binder | CDR-L1 | SEQ ID NO: | CDR-L2: | SEQ ID NO: | CDR-L3 | SEQ ID NO: |
|---|---|---|---|---|---|---|
| PALF16 | RASQSISSYLN | 79 | AASSLQS | 82 | QQSYSTPLT | 127 |
| PALF17 | RASQSISSYLN | 79 | AASSLQS | 82 | QQSYSTPLT | 127 |
| PALF18 | RASQSISSYLN | 79 | AASSLQS | 82 | QQSYSTPLT | 127 |

TABLE 11F-1-continued

AB1/AB2 family BCMA Binders- Light Chain CDR
sequences according to combination of Kabat
and Chothia numbering schemes

| Binder | CDR-L1 | SEQ ID NO: | CDR-L2: | SEQ ID NO: | CDR-L3 | SEQ ID NO: |
|---|---|---|---|---|---|---|
| PALF19 | RASQSISSYLN | 79 | AASSLQS | 82 | QQSYSTPLT | 127 |
| PALF20 | RASQSISSYLN | 79 | AASSLQS | 82 | QQSYSTPLT | 127 |

TABLE 11F-2

AB1/AB2 family BCMA Binders-Heavy Chain CDR sequences according to combination
of Kabat and Chothia numbering schemes

| Binder | CDR-H1 | SEQ ID NO: | CDR-H2: | SEQ ID NO: | CDR-H3 | SEQ ID NO: |
|---|---|---|---|---|---|---|
| AB1 | GFTFSSYAMS | 91 | AISGSGGSTYYA DSVKG | 135 | REWWYDDWYLDY | 98 |
| AB2 | GFTFSSYAMS | 91 | AISESGGRAAYA DSVKG | 136 | REWWYDDWYLDY | 98 |
| R1F2 | GFTFSSYAMS | 91 | AISGSGGSTYYA DSVKG | 135 | REWWYDDWYLDY | 98 |
| PALF03 | GFTFSSYAMS | 91 | AISGSGGSTYYA DSVKG | 135 | REWWYDDWYLDY | 98 |
| PALF04 | GFTFSSYAMS | 91 | AISGSGGSTYYA DSVKG | 135 | REWWYDDWYLDY | 98 |
| PALF05 | GFTFSSYAMS | 91 | AISGSGGSTYYA DSVKG | 135 | REWWYDDWYLDY | 98 |
| PALF06 | GFTFSSYAMS | 91 | AISGSGGSTYYA DSVKG | 135 | REWWYDDWYLDY | 98 |
| PALF07 | GFTFSSYAMS | 91 | AISGSGGSTYYA DSVKG | 135 | REWWYDDWYLDY | 98 |
| PALF08 | GFTFSSYAMS | 91 | AISGSGGSTYYA DSVKG | 135 | REWWYDDWYLDY | 98 |
| PALF09 | GFTFSSYAMS | 91 | AISGSGGSTYYA DSVKG | 135 | REWWYDDWYLDY | 98 |
| PALF12 | GFTFSSYAMS | 91 | AISGSGGRAAYA DSVKG | 137 | REWWYDDWYLDY | 98 |
| PALF13 | GFTFSSYAMS | 91 | AISESGDVEAYA DSVKG | 138 | REWWYDDWYLDY | 98 |
| PALF14 | GFTFSSYAMS | 91 | AISEAGETTSYA DSVKG | 139 | REWWYDDWYLDY | 98 |
| PALF15 | GFTFSSYAMS | 91 | AISEHGHYTSYA DSVKG | 140 | REWWYDDWYLDY | 98 |
| PALF16 | GFTFSSYAMS | 91 | AISGSGHTAAYA DSVKG | 141 | REWWYDDWYLDY | 98 |
| PALF17 | GFTFSSYAMS | 91 | AISGSGRTHAYA DSVKG | 142 | REWWYDDWYLDY | 98 |

TABLE 11F-2-continued

AB1/AB2 family BCMA Binders-Heavy Chain CDR sequences according to combination of Kabat and Chothia numbering schemes

| Binder | CDR-H1 | SEQ ID NO: | CDR-H2: | SEQ ID NO: | CDR-H3 | SEQ ID NO: |
|---|---|---|---|---|---|---|
| PALF18 | GFTFSSYAMS | 91 | AISAEGGVRAYA DSVKG | 143 | REWWYDDWYLDY | 98 |
| PALF19 | GFTFSSYAMS | 91 | AISGSGGTTAYA DSVKG | 144 | REWWYDDWYLDY | 98 |
| PALF20 | GFTFSSYAMS | 91 | AISGSGATTAYA DSVKG | 145 | REWWYDDWYLDY | 98 |

15

TABLE 11G-1

AB1/AB2 family BCMA Binders-Light Chain CDR sequences according to combination of Kabat and IMGT numbering schemes

| Binder | CDR-L1 | SEQ ID NO: | CDR-L2: | SEQ ID NO: | CDR-L3 | SEQ ID NO: |
|---|---|---|---|---|---|---|
| AB1 | RASQSISSYLN | 79 | AASSLQS | 82 | QQSYSSPLT | 126 |
| AB2 | RASQSISSYLN | 79 | AASSLQS | 82 | QQSYSTPLT | 127 |
| R1F2 | RASQSISSYLN | 79 | AASSLQS | 82 | QQSYSTPLT | 127 |
| PALF03 | RASQSISSYLN | 79 | AASSLQS | 82 | QQSYGSPPT | 128 |
| PALF04 | RASQSISSYLN | 79 | AASSLQS | 82 | QQSYDSPLT | 129 |
| PALF05 | RASQSISSYLN | 79 | AASSLQS | 82 | QQSYYSPLT | 130 |
| PALF06 | RASQSISSYLN | 79 | AASSLQS | 82 | QQSYYAPLT | 131 |
| PALF07 | RASQSISSYLN | 79 | AASSLQS | 82 | QQSYASPLT | 132 |
| PALF08 | RASQSISSYLN | 79 | AASSLQS | 82 | QQSYGSPLT | 133 |
| PALF09 | RASQSISSYLN | 79 | AASSLQS | 82 | QQSYDAPLT | 134 |
| PALF12 | RASQSISSYLN | 79 | AASSLQS | 82 | QQSYSTPLT | 127 |
| PALF13 | RASQSISSYLN | 79 | AASSLQS | 82 | QQSYSTPLT | 127 |
| PALF14 | RASQSISSYLN | 79 | AASSLQS | 82 | QQSYSTPLT | 127 |
| PALF15 | RASQSISSYLN | 79 | AASSLQS | 82 | QQSYSTPLT | 127 |
| PALF16 | RASQSISSYLN | 79 | AASSLQS | 82 | QQSYSTPLT | 127 |
| PALF17 | RASQSISSYLN | 79 | AASSLQS | 82 | QQSYSTPLT | 127 |
| PALF18 | RASQSISSYLN | 79 | AASSLQS | 82 | QQSYSTPLT | 127 |
| PALF19 | RASQSISSYLN | 79 | AASSLQS | 82 | QQSYSTPLT | 127 |
| PALF20 | RASQSISSYLN | 79 | AASSLQS | 82 | QQSYSTPLT | 127 |

TABLE 11G-2

AB1/AB2 family BCMA Binders-Heavy Chain
CDR sequences according to combination of Kabat
and IMGT numbering schemes

| Binder | CDR-H1 | SEQ ID NO: | CDR-H2: | SEQ ID NO: | CDR-H3 | SEQ ID NO: |
|---|---|---|---|---|---|---|
| AB1 | GFTFSSYA MS | 91 | AISGSGGSTYY ADSVKG | 135 | ARREWWYDDWY LDY | 99 |
| AB2 | GFTFSSYA MS | 91 | AISESGGRAAY ADSVKG | 136 | ARREWWYDDWY LDY | 99 |
| R1F2 | GFTFSSYA MS | 91 | AISGSGGSTYY ADSVKG | 135 | ARREWWYDDWY LDY | 99 |
| PALF03 | GFTFSSYA MS | 91 | AISGSGGSTYY ADSVKG | 135 | ARREWWYDDWY LDY | 99 |
| PALF04 | GFTFSSYA MS | 91 | AISGSGGSTYY ADSVKG | 135 | ARREWWYDDWY LDY | 99 |
| PALF05 | GFTFSSYA MS | 91 | AISGSGGSTYY ADSVKG | 135 | ARREWWYDDWY LDY | 99 |
| PALF06 | GFTFSSYA MS | 91 | AISGSGGSTYY ADSVKG | 135 | ARREWWYDDWY LDY | 99 |
| PALF07 | GFTFSSYA MS | 91 | AISGSGGSTYY ADSVKG | 135 | ARREWWYDDWY LDY | 99 |
| PALF08 | GFTFSSYA MS | 91 | AISGSGGSTYY ADSVKG | 135 | ARREWWYDDWY LDY | 99 |
| PALF09 | GFTFSSYA MS | 91 | AISGSGGSTYY ADSVKG | 135 | ARREWWYDDWY LDY | 99 |
| PALF12 | GFTFSSYA MS | 91 | AISGSGGRAAY ADSVKG | 137 | ARREWWYDDWY LDY | 99 |
| PALF13 | GFTFSSYA MS | 91 | AISESGDVEAY ADSVKG | 138 | ARREWWYDDWY LDY | 99 |
| PALF14 | GFTFSSYA MS | 91 | AISEAGETTSY ADSVKG | 139 | ARREWWYDDWY LDY | 99 |
| PALF15 | GFTFSSYA MS | 91 | AISEHGHYTSY ADSVKG | 140 | ARREWWYDDWY LDY | 99 |
| PALF16 | GFTFSSYA MS | 91 | AISGSGHTAAY ADSVKG | 141 | ARREWWYDDWY LDY | 99 |
| PALF17 | GFTFSSYA MS | 91 | AISGSGRTHAY ADSVKG | 142 | ARREWWYDDWY LDY | 99 |
| PALF18 | GFTFSSYA MS | 91 | AISAEGGVRAY ADSVKG | 143 | ARREWWYDDWY LDY | 99 |
| PALF19 | GFTFSSYA MS | 91 | AISGSGGTTAY ADSVKG | 144 | ARREWWYDDWY LDY | 99 |
| PALF20 | GFTFSSYA MS | 91 | AISGSGATTAY ADSVKG | 145 | ARREWWYDDWY LDY | 99 |

TABLE 11H-1

AB1/AB2 family BCMA Binders-Light Chain
CDR sequences according to combination of
Chothia and IMGT numbering schemes

| Binder | CDR-L1 | SEQ ID NO: | CDR-L2: | SEQ ID NO: | CDR-L3 | SEQ ID NO: |
|---|---|---|---|---|---|---|
| AB1 | SQSISSY | 80 | AAS | 83 | QQSYSSPLT | 126 |
| AB2 | SQSISSY | 80 | AAS | 83 | QQSYSTPLT | 127 |
| R1F2 | SQSISSY | 80 | AAS | 83 | QQSYSTPLT | 127 |
| PALF03 | SQSISSY | 80 | AAS | 83 | QQSYGSPPT | 128 |
| PALF04 | SQSISSY | 80 | AAS | 83 | QQSYDSPLT | 129 |
| PALF05 | SQSISSY | 80 | AAS | 83 | QQSYYSPLT | 130 |
| PALF06 | SQSISSY | 80 | AAS | 83 | QQSYYAPLT | 131 |
| PALF07 | SQSISSY | 80 | AAS | 83 | QQSYASPLT | 132 |
| PALF08 | SQSISSY | 80 | AAS | 83 | QQSYGSPLT | 133 |
| PALF09 | SQSISSY | 80 | AAS | 83 | QQSYDAPLT | 134 |
| PALF12 | SQSISSY | 80 | AAS | 83 | QQSYSTPLT | 127 |
| PALF13 | SQSISSY | 80 | AAS | 83 | QQSYSTPLT | 127 |
| PALF14 | SQSISSY | 80 | AAS | 83 | QQSYSTPLT | 127 |
| PALF15 | SQSISSY | 80 | AAS | 83 | QQSYSTPLT | 127 |
| PALF16 | SQSISSY | 80 | AAS | 83 | QQSYSTPLT | 127 |
| PALF17 | SQSISSY | 80 | AAS | 83 | QQSYSTPLT | 127 |
| PALF18 | SQSISSY | 80 | AAS | 83 | QQSYSTPLT | 127 |
| PALF19 | SQSISSY | 80 | AAS | 83 | QQSYSTPLT | 127 |
| PALF20 | SQSISSY | 80 | AAS | 83 | QQSYSTPLT | 127 |

TABLE 11H-2

AB1/AB2 family BCMA Binders-Heavy Chain
CDR sequences according to combination of
Chothia and IMGT numbering schemes

| Binder | CDR-H1 | SEQ ID NO: | CDR-H2: | SEQ ID NO: | CDR-H3 | SEQ ID NO: |
|---|---|---|---|---|---|---|
| AB1 | GFTFSSYA | 90 | ISGSGGST | 165 | ARREWWYDDWY LDY | 99 |
| AB2 | GFTFSSYA | 90 | ISESGGRA | 166 | ARREWWYDDWY LDY | 99 |
| R1F2 | GFTFSSYA | 90 | ISGSGGST | 165 | ARREWWYDDWY LDY | 99 |
| PALF03 | GFTFSSYA | 90 | ISGSGGST | 165 | ARREWWYDDWY LDY | 99 |
| PALF04 | GFTFSSYA | 90 | ISGSGGST | 165 | ARREWWYDDWY LDY | 99 |
| PALF05 | GFTFSSYA | 90 | ISGSGGST | 165 | ARREWWYDDWY LDY | 99 |
| PALF06 | GFTFSSYA | 90 | ISGSGGST | 165 | ARREWWYDDWY LDY | 99 |

TABLE 11H-2-continued

AB1/AB2 family BCMA Binders-Heavy Chain
CDR sequences according to combination of
Chothia and IMGT numbering schemes

| Binder | CDR-H1 | SEQ ID NO: | CDR-H2: | SEQ ID NO: | CDR-H3 | SEQ ID NO: |
|---|---|---|---|---|---|---|
| PALF07 | GFTFSSYA | 90 | ISGSGGST | 165 | ARREWWYDDWYLDY | 99 |
| PALF08 | GFTFSSYA | 90 | ISGSGGST | 165 | ARREWWYDDWYLDY | 99 |
| PALF09 | GFTFSSYA | 90 | ISGSGGST | 165 | ARREWWYDDWYLDY | 99 |
| PALF12 | GFTFSSYA | 90 | ISGSGGRA | 167 | ARREWWYDDWYLDY | 99 |
| PALF13 | GFTFSSYA | 90 | ISESGDVE | 168 | ARREWWYDDWYLDY | 99 |
| PALF14 | GFTFSSYA | 90 | ISESGDVE | 168 | ARREWWYDDWYLDY | 99 |
| PALF15 | GFTFSSYA | 90 | ISEHGHYT | 169 | ARREWWYDDWYLDY | 99 |
| PALF16 | GFTFSSYA | 90 | ISGSGHTA | 170 | ARREWWYDDWYLDY | 99 |
| PALF17 | GFTFSSYA | 90 | ISGSGRTH | 171 | ARREWWYDDWYLDY | 99 |
| PALF18 | GFTFSSYA | 90 | ISAEGGVR | 172 | ARREWWYDDWYLDY | 99 |
| PALF19 | GFTFSSYA | 90 | ISGSGGTT | 173 | ARREWWYDDWYLDY | 99 |
| PALF20 | GFTFSSYA | 90 | ISGSGATT | 174 | ARREWWYDDWYLDY | 99 |

TABLE 11I-1

AB3 family BCMA Binders-Light Chain CDR
sequences according to Kabat numbering scheme

| Binder | CDR-L1 | SEQ ID NO: | CDR-L2: | SEQ ID NO: | CDR-L3 | SEQ ID NO: |
|---|---|---|---|---|---|---|
| AB3 | TGTSSDVGGYNYVS | 100 | DVSNRLR | 175 | SSYTSSSALYV | 183 |
| PI-61 | TGTSSDVGGYNYVS | 100 | DVSNRPS | 176 | SSYTSSSTLYV | 184 |
| H2/L2-22 | TGTSSDVGGYNYVS | 100 | EVSNRLS | 177 | SSYTSSSTLYV | 184 |
| H2/L2-88 | TGTSSDVGGYNYVS | 100 | EVSNRLR | 178 | SSYTSSSALYV | 183 |
| H2/L2-36 | TGTSSDVGGYNYVS | 100 | EVSNRLR | 178 | SSYTSSSTLYV | 184 |
| H2/L2-34 | TGTSSDVGGYNYVS | 100 | DVSNRPW | 179 | SSYTSSSALYV | 183 |
| H2/L2-68 | TGTSSDVGGYNYVS | 100 | DVSNRLS | 180 | SSYTSSSTLYV | 184 |
| H2/L2-18 | TGTSSDVGGYNYVS | 100 | DVSNRPW | 179 | SSYTSSSTLYV | 184 |

TABLE 11I-1-continued

AB3 family BCMA Binders-Light Chain CDR
sequences according to Kabat numbering scheme

| Binder | CDR-L1 | SEQ ID NO: | CDR-L2: | SEQ ID NO: | CDR-L3 | SEQ ID NO: |
|---|---|---|---|---|---|---|
| H2/L2-47 | TGTSSDVGGYNYVS | 100 | DVSNRPW | 179 | SSYTSSSTLYV | 184 |
| H2/L2-20 | TGTSSDVGGYNYVS | 100 | DVSNRLR | 175 | SSYTSSSALYV | 183 |
| H2/L2-80 | TGTSSDVGGYNYVS | 100 | DVSNRAW | 181 | SSYTSSSALYV | 183 |
| H2/L2-83 | TGTSSDVGGYNYVS | 100 | EVSNRLR | 178 | SSYTSSSTLYV | 184 |
| H3-1 | TGTSSDVGGYNYVS | 100 | EVSNRLR | 178 | SSYTSSSTLYV | 184 |
| H3-2 | TGTSSDVGGYNYVS | 100 | EVSNRLR | 178 | SSYTSSSTLYV | 184 |
| H3-3 | TGTSSDVGGYNYVS | 100 | EVSNRLR | 178 | SSYTSSSTLYV | 184 |
| H3-4 | TGTSSDVGGYNYVS | 100 | EVSNRLR | 178 | SSYTSSSALYV | 183 |
| H3-5 | TGTSSDVGGYNYVS | 100 | EVSNRLS | 177 | SSYTSSSTLYV | 184 |
| H3-6 | TGTSSDVGGYNYVS | 100 | EVSNRLR | 178 | SSYTSSSALYV | 183 |
| H3-7 | TGTSSDVGGYNYVS | 100 | EVSNRLR | 178 | SSYTSSSTLYV | 184 |
| H3-8 | TGTSSDVGGYNYVS | 100 | EVSNRLR | 178 | SSYTSSSTLYV | 184 |
| H3-9 | TGTSSDVGGYNYVS | 100 | EVSNRLR | 178 | SSYTSSSTLYV | 184 |
| H3-10 | TGTSSDVGGYNYVS | 100 | EVSNRLR | 178 | SSYTSSSTLYV | 184 |
| H3-11 | TGTSSDVGGYNYVS | 100 | EVSNRLR | 178 | SSYTSSSTLYV | 184 |
| H3-12 | TGTSSDVGGYNYVS | 100 | EVSNRLR | 178 | SSYTSSSTLYV | 184 |
| H3-13 | TGTSSDVGGYNYVS | 100 | EVSNRLR | 178 | SSYTSSSTLYV | 184 |
| H3-14 | TGTSSDVGGYNYVS | 100 | EVSNRLS | 177 | SSYTSSSALYV | 183 |
| H3-15 | TGTSSDVGGYNYVS | 100 | EVSNRLG | 182 | SSYTSSSALYV | 183 |

107

TABLE 11I-2

AB3 family BCMA Binders-Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| AB3 | SYGMH | 112 | VISYTGSNKYYAD SVKG | 185 | SGYALHDDYYGLD V | 122 |
| PI-61 | SYGMH | 112 | VISYDGSNKYYAD SVKG | 186 | SGYALHDDYYGLD V | 122 |
| H2/L2-22 | SYGMH | 112 | VISYHGSNKYYAD SVKG | 187 | SGYALHDDYYGLD V | 122 |
| H2/L2-88 | SYGMH | 112 | VISYKGSNKYYAD SVKG | 188 | SGYALHDDYYGLD V | 122 |
| H2/L2-36 | SYGMH | 112 | VISYKGSNKYYAD SVKG | 188 | SGYALHDDYYGLD V | 122 |
| H2/L2-34 | SYGMH | 112 | VISYTGTKKYYAD SVKG | 189 | SGYALHDDYYGLD V | 122 |
| H2/L2-68 | SYGMH | 112 | VISYRGFNKYYAD SVKG | 190 | SGYALHDDYYGQD V | 199 |
| H2/L2-18 | SYGMH | 112 | VISYKGSHKYYAD SVKG | 191 | SGYALHDDYYGLD V | 122 |
| H2/L2-47 | SYGMH | 112 | VISYKGSNKYYAD SVKG | 188 | SGYALHDDYYGLD V | 122 |
| H2/L2-20 | SYGMH | 112 | VISYTGSNKYYAD SVKG | 185 | SGYALHDDYYGLD V | 122 |
| H2/L2-80 | SYGMH | 112 | VISYTGSNKYYAD SVKG | 185 | SGYALHDDYYGLD V | 122 |
| H2/L2-83 | SYGMH | 112 | VISYKGSNKYYAD SVKG | 188 | SGYALHDDYYGLD V | 122 |
| H3-1 | SYGMH | 112 | VISYDDAHKYYAD SVKG | 192 | SGYALHDQYKPVD V | 200 |
| H3-2 | SYGMH | 112 | VISYNDLNKYYAD SVKG | 193 | SGYALHDFQDPTD V | 201 |
| H3-3 | SYGMH | 112 | VISYSGSNKYYAD SVKG | 194 | SGYALHDQYKPVD V | 200 |
| H3-4 | SYGMH | 112 | VISYDDAHKYYAD SVKG | 192 | SGYALHDQYKPVD V | 200 |
| H3-5 | SYGMH | 112 | VISYTGANKYYAD SVKG | 195 | SGYNLHDDYYGLD V | 202 |
| H3-6 | SYGMH | 112 | VISYDDAHKYYAD SVKG | 192 | SGYALHDQYKPVD V | 200 |
| H3-7 | SYGMH | 112 | VISYTGSNKYYAD SVKG | 185 | SGYEFHEDYYGLD V | 203 |
| H3-8 | SYGMH | 112 | VISYDDAHKYYAD SVKG | 192 | SGYALHDQYKPVD V | 200 |
| H3-9 | SYGMH | 112 | VISYDDAHKYYAD SVKG | 192 | SGYALHDQYKPVD V | 200 |
| H3-10 | SYGMH | 112 | VISYNDLNKYYAD SVKG | 193 | SGYEFQGDYYGLD V | 204 |
| H3-11 | SYGMH | 112 | VISYNDANKYYAD SVKG | 196 | SGYELRDDYYGLD V | 205 |
| H3-12 | SYGMH | 112 | VISYDESNKYYAD SVKG | 197 | SGYEVDQDYYGLD V | 206 |

108

TABLE 11I-2-continued

AB3 family BCMA Binders-Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| H3-13 | SYGMH | 112 | VISYDDAHKYYAD SVKG | 192 | SGYALHDQYKPVD V | 200 |
| H3-14 | SYGMH | 112 | VISYDDAHKYYAD SVKG | 192 | SGYALHDQYKPVD V | 200 |
| H3-15 | SYGMH | 112 | VISYDDANKYYAD SVKG | 198 | SGYAYDGDYYGLD V | 207 |

TABLE 11J-1

AB3 family BCMA Binders-Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| AB3 | TSSDVGGYNY | 101 | DVS | 105 | YTSSSALY | 209 |
| PI-61 | TSSDVGGYNY | 101 | DVS | 105 | YTSSSTLY | 210 |
| H2/L2-22 | TSSDVGGYNY | 101 | EVS | 208 | YTSSSTLY | 210 |
| H2/L2-88 | TSSDVGGYNY | 101 | EVS | 208 | YTSSSALY | 209 |
| H2/L2-36 | TSSDVGGYNY | 101 | EVS | 208 | YTSSSTLY | 210 |
| H2/L2-34 | TSSDVGGYNY | 101 | DVS | 105 | YTSSSALY | 209 |
| H2/L2-68 | TSSDVGGYNY | 101 | DVS | 105 | YTSSSTLY | 210 |
| H2/L2-18 | TSSDVGGYNY | 101 | DVS | 105 | YTSSSTLY | 210 |
| H2/L2-47 | TSSDVGGYNY | 101 | DVS | 105 | YTSSSTLY | 210 |
| H2/L2-20 | TSSDVGGYNY | 101 | DVS | 105 | YTSSSALY | 209 |
| H2/L2-80 | TSSDVGGYNY | 101 | DVS | 105 | YTSSSALY | 209 |
| H2/L2-83 | TSSDVGGYNY | 101 | EVS | 208 | YTSSSTLY | 210 |
| H3-1 | TSSDVGGYNY | 101 | EVS | 208 | YTSSSTLY | 210 |
| H3-2 | TSSDVGGYNY | 101 | EVS | 208 | YTSSSTLY | 210 |
| H3-3 | TSSDVGGYNY | 101 | EVS | 208 | YTSSSTLY | 210 |
| H3-4 | TSSDVGGYNY | 101 | EVS | 208 | YTSSSALY | 209 |
| H3-5 | TSSDVGGYNY | 101 | EVS | 208 | YTSSSTLY | 210 |
| H3-6 | TSSDVGGYNY | 101 | EVS | 208 | YTSSSALY | 209 |
| H3-7 | TSSDVGGYNY | 101 | EVS | 208 | YTSSSTLY | 210 |
| H3-8 | TSSDVGGYNY | 101 | EVS | 208 | YTSSSTLY | 210 |
| H3-9 | TSSDVGGYNY | 101 | EVS | 208 | YTSSSTLY | 210 |
| H3-10 | TSSDVGGYNY | 101 | EVS | 208 | YTSSSTLY | 210 |
| H3-11 | TSSDVGGYNY | 101 | EVS | 208 | YTSSSTLY | 210 |
| H3-12 | TSSDVGGYNY | 101 | EVS | 208 | YTSSSTLY | 210 |

TABLE 11J-1-continued

AB3 family BCMA Binders-Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| H3-13 | TSSDVGGYNY | 101 | EVS | 208 | YTSSSTLY | 210 |
| H3-14 | TSSDVGGYNY | 101 | EVS | 208 | YTSSSALY | 209 |
| H3-15 | TSSDVGGYNY | 101 | EVS | 208 | YTSSSALY | 209 |

TABLE 11J-2

AB3 family BCMA Binders-Heavy Chain CDR sequences according to Chothia numbering scheme

| Binder | CDR-H1 | SEQ ID NO: | CDR-H2: | SEQ ID NO: | CDR-H3 | SEQ ID NO: |
|---|---|---|---|---|---|---|
| AB3 | GFTVSSY | 211 | SYTGSN | 213 | SGYALHDDYYGLDV | 122 |
| PI-61 | GFTFSSY | 89 | SYDGSN | 214 | SGYALHDDYYGLDV | 122 |
| H2/L2-22 | GFTFSSY | 89 | SYHGSN | 215 | SGYALHDDYYGLDV | 122 |
| H2/L2-88 | GFTFSSY | 89 | SYKGSN | 216 | SGYALHDDYYGLDV | 122 |
| H2/L2-36 | GFTFSSY | 89 | SYKGSN | 216 | SGYALHDDYYGLDV | 122 |
| H2/L2-34 | GFTFSSY | 89 | SYTGTK | 217 | SGYALHDDYYGLDV | 122 |
| H2/L2-68 | GFTFSSY | 89 | SYRGFN | 218 | SGYALHDDYYGQDV | 199 |
| H2/L2-18 | GFTFSSY | 89 | SYKGSH | 219 | SGYALHDDYYGLDV | 122 |
| H2/L2-47 | GFTFSSY | 89 | SYKGSN | 216 | SGYALHDDYYGLDV | 122 |
| H2/L2-20 | GFTVSSY | 211 | SYTGSN | 213 | SGYALHDDYYGLDV | 122 |
| H2/L2-80 | GFTFSSY | 89 | SYTGSN | 213 | SGYALHDDYYGLDV | 122 |
| H2/L2-83 | GFTFSSY | 89 | SYKGSN | 216 | SGYALHDDYYGLDV | 122 |
| H3-1 | GFTFSSY | 89 | SYDDAH | 220 | SGYALHDQYKPVDV | 200 |
| H3-2 | GFTFSSY | 89 | SYNDLN | 221 | SGYALHDFQDPTDV | 201 |
| H3-3 | GFTVSSY | 211 | SYSGSN | 222 | SGYALHDQYKPVDV | 200 |
| H3-4 | GFTFSSY | 89 | SYDDAH | 220 | SGYALHDQYKPVDV | 200 |
| H3-5 | GFTFSSY | 89 | SYTGAN | 223 | SGYNLHDDYYGLDV | 202 |
| H3-6 | GFTFSSY | 89 | SYDDAH | 220 | SGYALHDQYKPVDV | 200 |

TABLE 11J-2-continued

AB3 family BCMA Binders-Heavy Chain CDR sequences according to Chothia numbering scheme

| Binder | CDR-H1 | SEQ ID NO: | CDR-H2: | SEQ ID NO: | CDR-H3 | SEQ ID NO: |
|---|---|---|---|---|---|---|
| H3-7 | GFTLSSY | 212 | SYTGSN | 213 | SGYEFHEDYYGLDV | 203 |
| H3-8 | GFTFSSY | 89 | SYDDAH | 220 | SGYALHDQYKPVDV | 200 |
| H3-9 | GFTFSSY | 89 | SYDDAH | 220 | SGYALHDQYKPVDV | 200 |
| H3-10 | GFTFSSY | 89 | SYNDLN | 221 | SGYEFQGDYYGLDV | 204 |
| H3-11 | GFTFSSY | 89 | SYNDAN | 224 | SGYELRDDYYGLDV | 205 |
| H3-12 | GFTFSSY | 89 | SYDESN | 225 | SGYEVDQDYYGLDV | 206 |
| H3-13 | GFTFSSY | 89 | SYDDAH | 220 | SGYALHDQYKPVDV | 200 |
| H3-14 | GFTFSSY | 89 | SYDDAH | 220 | SGYALHDQYKPVDV | 200 |
| H3-15 | GFTVSSY | 211 | SYDDAN | 226 | SGYAYDGDYYGLDV | 207 |

TABLE 11K-1(a)

AB3 family BCMA Binders-CDR-L1 and CDR-L3 sequences according to IMGT numbering scheme and CDR-L2 expanded sequences

| Binder | CDR-L1 | SEQ ID NO: | CDR-L2 | SEQ ID NO: | CDR-L3 | SEQ ID NO: |
|---|---|---|---|---|---|---|
| AB3 | SSDVGGYNY | 102 | DVSNRLRGVS | 227 | SSYTSSSALYV | 183 |
| PI-61 | SSDVGGYNY | 102 | DVSNRPSGVS | 228 | SSYTSSSTLYV | 184 |
| H2/L2-22 | SSDVGGYNY | 102 | EVSNRLSGVS | 229 | SSYTSSSTLYV | 184 |
| H2/L2-88 | SSDVGGYNY | 102 | EVSNRLRGVS | 230 | SSYTSSSALYV | 183 |
| H2/L2-36 | SSDVGGYNY | 102 | EVSNRLRGVS | 230 | SSYTSSSTLYV | 184 |
| H2/L2-34 | SSDVGGYNY | 102 | DVSNRPWGVS | 231 | SSYTSSSALYV | 183 |
| H2/L2-68 | SSDVGGYNY | 102 | DVSNRLSGVS | 232 | SSYTSSSTLYV | 184 |
| H2/L2-18 | SSDVGGYNY | 102 | DVSNRPWGVS | 231 | SSYTSSSTLYV | 184 |
| H2/L2-47 | SSDVGGYNY | 102 | DVSNRPWGVS | 231 | SSYTSSSTLYV | 184 |
| H2/L2-20 | SSDVGGYNY | 102 | DVSNRLRGVS | 227 | SSYTSSSALYV | 183 |
| H2/L2-80 | SSDVGGYNY | 102 | DVSNRAWGVS | 233 | SSYTSSSALYV | 183 |
| H2/L2-83 | SSDVGGYNY | 102 | EVSNRLRGVS | 230 | SSYTSSSTLYV | 184 |
| H3-1 | SSDVGGYNY | 102 | EVSNRLRGVS | 230 | SSYTSSSTLYV | 184 |
| H3-2 | SSDVGGYNY | 102 | EVSNRLRGVS | 230 | SSYTSSSTLYV | 184 |
| H3-3 | SSDVGGYNY | 102 | EVSNRLRGVS | 230 | SSYTSSSTLYV | 184 |
| H3-4 | SSDVGGYNY | 102 | EVSNRLRGVS | 230 | SSYTSSSALYV | 183 |
| H3-5 | SSDVGGYNY | 102 | EVSNRLSGVS | 229 | SSYTSSSTLYV | 184 |

TABLE 11K-1(a)-continued

AB3 family BCMA Binders-CDR-L1 and
CDR-L3 sequences according to IMGT numbering
scheme and CDR-L2 expanded sequences

| Binder | CDR-L1 | SEQ ID NO: | CDR-L2 | SEQ ID NO: | CDR-L3 | SEQ ID NO: |
|---|---|---|---|---|---|---|
| H3-6 | SSDVGGYNY | 102 | EVSNRLRGVS | 230 | SSYTSSSALYV | 183 |
| H3-7 | SSDVGGYNY | 102 | EVSNRLRGVS | 230 | SSYTSSSTLYV | 184 |
| H3-8 | SSDVGGYNY | 102 | EVSNRLRGVS | 230 | SSYTSSSTLYV | 184 |
| H3-9 | SSDVGGYNY | 102 | EVSNRLRGVS | 230 | SSYTSSSTLYV | 184 |
| H3-10 | SSDVGGYNY | 102 | EVSNRLRGVS | 230 | SSYTSSSTLYV | 184 |
| H3-11 | SSDVGGYNY | 102 | EVSNRLRGVS | 230 | SSYTSSSTLYV | 184 |
| H3-12 | SSDVGGYNY | 102 | EVSNRLRGVS | 230 | SSYTSSSTLYV | 184 |
| H3-13 | SSDVGGYNY | 102 | EVSNRLRGVS | 230 | SSYTSSSTLYV | 184 |
| H3-14 | SSDVGGYNY | 102 | EVSNRLSGVS | 229 | SSYTSSSALYV | 183 |
| H3-15 | SSDVGGYNY | 102 | EVSNRLGGVS | 234 | SSYTSSSALYV | 183 |

TABLE 11K-1(b)

AB3 family BCMA Binders-Light Chain CDR
sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| AB3 | SSDVGGYNY | 102 | DVS | 105 | SSYTSSSALYV | 183 |
| PI-61 | SSDVGGYNY | 102 | DVS | 105 | SSYTSSSTLYV | 184 |
| H2/L2-22 | SSDVGGYNY | 102 | EVS | 208 | SSYTSSSTLYV | 184 |
| H2/L2-88 | SSDVGGYNY | 102 | EVS | 208 | SSYTSSSALYV | 183 |
| H2/L2-36 | SSDVGGYNY | 102 | EVS | 208 | SSYTSSSTLYV | 184 |
| H2/L2-34 | SSDVGGYNY | 102 | DVS | 105 | SSYTSSSALYV | 183 |
| H2/L2-68 | SSDVGGYNY | 102 | DVS | 105 | SSYTSSSTLYV | 184 |
| H2/L2-18 | SSDVGGYNY | 102 | DVS | 105 | SSYTSSSTLYV | 184 |
| H2/L2-47 | SSDVGGYNY | 102 | DVS | 105 | SSYTSSSTLYV | 184 |
| H2/L2-20 | SSDVGGYNY | 102 | DVS | 105 | SSYTSSSALYV | 183 |
| H2/L2-80 | SSDVGGYNY | 102 | DVS | 105 | SSYTSSSALYV | 183 |
| H2/L2-83 | SSDVGGYNY | 102 | EVS | 208 | SSYTSSSTLYV | 184 |
| H3-1 | SSDVGGYNY | 102 | EVS | 208 | SSYTSSSTLYV | 184 |
| H3-2 | SSDVGGYNY | 102 | EVS | 208 | SSYTSSSTLYV | 184 |
| H3-3 | SSDVGGYNY | 102 | EVS | 208 | SSYTSSSTLYV | 184 |
| H3-4 | SSDVGGYNY | 102 | EVS | 208 | SSYTSSSALYV | 183 |
| H3-5 | SSDVGGYNY | 102 | EVS | 208 | SSYTSSSTLYV | 184 |
| H3-6 | SSDVGGYNY | 102 | EVS | 208 | SSYTSSSALYV | 183 |
| H3-7 | SSDVGGYNY | 102 | EVS | 208 | SSYTSSSTLYV | 184 |
| H3-8 | SSDVGGYNY | 102 | EVS | 208 | SSYTSSSTLYV | 184 |

TABLE 11K-1(b)-continued

AB3 family BCMA Binders-Light Chain CDR
sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| H3-9 | SSDVGGYNY | 102 | EVS | 208 | SSYTSSSTLYV | 184 |
| H3-10 | SSDVGGYNY | 102 | EVS | 208 | SSYTSSSTLYV | 184 |
| H3-11 | SSDVGGYNY | 102 | EVS | 208 | SSYTSSSTLYV | 184 |
| H3-12 | SSDVGGYNY | 102 | EVS | 208 | SSYTSSSTLYV | 184 |
| H3-13 | SSDVGGYNY | 102 | EVS | 208 | SSYTSSSTLYV | 184 |
| H3-14 | SSDVGGYNY | 102 | EVS | 208 | SSYTSSSALYV | 183 |
| H3-15 | SSDVGGYNY | 102 | EVS | 208 | SSYTSSSALYV | 183 |

TABLE 11K-2

AB3 family BCMA Binders-Heavy Chain CDR
sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| AB3 | GFTVSSYG | 235 | ISYTGSNK | 238 | GGSGYALHDDYYGLDV | 124 |
| PI-61 | GFTFSSYG | 236 | ISYDGSNK | 239 | GGSGYALHDDYYGLDV | 124 |
| H2/L2-22 | GFTFSSYG | 236 | ISYHGSNK | 240 | GGSGYALHDDYYGLDV | 124 |
| H2/L2-88 | GFTFSSYG | 236 | ISYKGSNK | 241 | GGSGYALHDDYYGLDV | 124 |
| H2/L2-36 | GFTFSSYG | 236 | ISYKGSNK | 241 | GGSGYALHDDYYGLDV | 124 |
| H2/L2-34 | GFTFSSYG | 236 | ISYTGTKK | 242 | GGSGYALHDDYYGLDV | 124 |
| H2/L2-68 | GFTFSSYG | 236 | ISYRGFNK | 243 | GGSGYALHDDYYGQDV | 252 |
| H2/L2-18 | GFTFSSYG | 236 | ISYKGSHK | 244 | GGSGYALHDDYYGLDV | 124 |
| H2/L2-47 | GFTFSSYG | 236 | ISYKGSNK | 241 | GGSGYALHDDYYGLDV | 124 |
| H2/L2-20 | GFTVSSYG | 235 | ISYTGSNK | 238 | GGSGYALHDDYYGLDV | 124 |
| H2/L2-80 | GFTFSSYG | 236 | ISYTGSNK | 238 | GGSGYALHDDYYGLDV | 124 |
| H2/L2-83 | GFTFSSYG | 236 | ISYKGSNK | 241 | GGSGYALHDDYYGLDV | 124 |
| H3-1 | GFTFSSYG | 236 | ISYDDAHK | 245 | GGSGYALHDQYKPVDV | 253 |
| H3-2 | GFTFSSYG | 236 | ISYNDLNK | 246 | GGSGYALHDFQDPTDV | 254 |
| H3-3 | GFTVSSYG | 235 | ISYSGSNK | 247 | GGSGYALHDQYKPVDV | 253 |

113

TABLE 11K-2-continued

AB3 family BCMA Binders-Heavy Chain CDR
sequences according to IMGT numbering scheme

| Binder | CDR-H1 | SEQ ID NO: | CDR-H2: | SEQ ID NO: | CDR-H3 | SEQ ID NO: |
|---|---|---|---|---|---|---|
| H3-4 | GFTFSSYG | 236 | ISYDDAHK | 245 | GGSGYALHDQYKPVDV | 253 |
| H3-5 | GFTFSSYG | 236 | ISYTGANK | 248 | GGSGYNLHDDYYGLDV | 255 |
| H3-6 | GFTFSSYG | 236 | ISYDDAHK | 245 | GGSGYALHDQYKPVDV | 253 |
| H3-7 | GFTLSSYG | 237 | ISYTGSNK | 238 | GGSGYEFHEDYYGLDV | 256 |
| H3-8 | GFTFSSYG | 236 | ISYDDAHK | 245 | GGSGYALHDQYKPVDV | 253 |
| H3-9 | GFTFSSYG | 236 | ISYDDAHK | 245 | GGSGYALHDQYKPVDV | 253 |
| H3-10 | GFTFSSYG | 236 | ISYNDLNK | 246 | GGSGYEFQGDYYGLDV | 257 |
| H3-11 | GFTFSSYG | 236 | ISYNDANK | 249 | GGSGYELRDDYYGLDV | 258 |
| H3-12 | GFTFSSYG | 236 | ISYDESNK | 250 | GGSGYEVDQDYYGLDV | 259 |
| H3-13 | GFTFSSYG | 236 | ISYDDAHK | 245 | GGSGYALHDQYKPVDV | 253 |
| H3-14 | GFTFSSYG | 236 | ISYDDAHK | 245 | GGSGYALHDQYKPVDV | 253 |
| H3-15 | GFTVSSYG | 235 | ISYDDANK | 251 | GGSGYAYDGDYYGLDV | 260 |

TABLE 11L-1

AB3 family BCMA Binders-Light Chain CDR
sequences according to combination of Kabat
and Chothia numbering schemes

| Binder | CDR-L1 | SEQ ID NO: | CDR-L2: | SEQ ID NO: | CDR-L3 | SEQ ID NO: |
|---|---|---|---|---|---|---|
| AB3 | TGTSSDVGGYNYVS | 100 | DVSNRLR | 175 | SSYTSSSALYV | 183 |
| PI-61 | TGTSSDVGGYNYVS | 100 | DVSNRPS | 176 | SSYTSSSTLYV | 184 |
| H2/L2-22 | TGTSSDVGGYNYVS | 100 | EVSNRLS | 177 | SSYTSSSTLYV | 184 |
| H2/L2-88 | TGTSSDVGGYNYVS | 100 | EVSNRLR | 178 | SSYTSSSALYV | 183 |
| H2/L2-36 | TGTSSDVGGYNYVS | 100 | EVSNRLR | 178 | SSYTSSSTLYV | 184 |
| H2/L2-34 | TGTSSDVGGYNYVS | 100 | DVSNRPW | 179 | SSYTSSSALYV | 183 |
| H2/L2-68 | TGTSSDVGGYNYVS | 100 | DVSNRLS | 180 | SSYTSSSTLYV | 184 |
| H2/L2-18 | TGTSSDVGGYNYVS | 100 | DVSNRPW | 179 | SSYTSSSTLYV | 184 |

114

TABLE 11L-1-continued

AB3 family BCMA Binders-Light Chain CDR
sequences according to combination of Kabat
and Chothia numbering schemes

| Binder | CDR-L1 | SEQ ID NO: | CDR-L2: | SEQ ID NO: | CDR-L3 | SEQ ID NO: |
|---|---|---|---|---|---|---|
| H2/L2-47 | TGTSSDVGGYNYVS | 100 | DVSNRPW | 179 | SSYTSSSTLYV | 184 |
| H2/L2-20 | TGTSSDVGGYNYVS | 100 | DVSNRLR | 175 | SSYTSSSALYV | 183 |
| H2/L2-80 | TGTSSDVGGYNYVS | 100 | DVSNRAW | 181 | SSYTSSSALYV | 183 |
| H2/L2-83 | TGTSSDVGGYNYVS | 100 | EVSNRLR | 178 | SSYTSSSTLYV | 184 |
| H3-1 | TGTSSDVGGYNYVS | 100 | EVSNRLR | 178 | SSYTSSSTLYV | 184 |
| H3-2 | TGTSSDVGGYNYVS | 100 | EVSNRLR | 178 | SSYTSSSTLYV | 184 |
| H3-3 | TGTSSDVGGYNYVS | 100 | EVSNRLR | 178 | SSYTSSSTLYV | 184 |
| H3-4 | TGTSSDVGGYNYVS | 100 | EVSNRLR | 178 | SSYTSSSALYV | 183 |
| H3-5 | TGTSSDVGGYNYVS | 100 | EVSNRLS | 177 | SSYTSSSTLYV | 184 |
| H3-6 | TGTSSDVGGYNYVS | 100 | EVSNRLR | 178 | SSYTSSSALYV | 183 |
| H3-7 | TGTSSDVGGYNYVS | 100 | EVSNRLR | 178 | SSYTSSSTLYV | 184 |
| H3-8 | TGTSSDVGGYNYVS | 100 | EVSNRLR | 178 | SSYTSSSTLYV | 184 |
| H3-9 | TGTSSDVGGYNYVS | 100 | EVSNRLR | 178 | SSYTSSSTLYV | 184 |
| H3-10 | TGTSSDVGGYNYVS | 100 | EVSNRLR | 178 | SSYTSSSTLYV | 184 |
| H3-11 | TGTSSDVGGYNYVS | 100 | EVSNRLR | 178 | SSYTSSSTLYV | 184 |
| H3-12 | TGTSSDVGGYNYVS | 100 | EVSNRLR | 178 | SSYTSSSTLYV | 184 |
| H3-13 | TGTSSDVGGYNYVS | 100 | EVSNRLR | 178 | SSYTSSSTLYV | 184 |
| H3-14 | TGTSSDVGGYNYVS | 100 | EVSNRLS | 177 | SSYTSSSALYV | 183 |
| H3-15 | TGTSSDVGGYNYVS | 100 | EVSNRLG | 182 | SSYTSSSALYV | 183 |

TABLE 11L-2

AB3 family BCMA Binders-Heavy Chain CDR sequences according to combination of Kabat and Chothia numbering schemes

| Binder | CDR-H1 | SEQ ID NO: | CDR-H2: | SEQ ID NO: | CDR-H3 | SEQ ID NO: |
|---|---|---|---|---|---|---|
| AB3 | GFTVSSYGMH | 261 | VISYTGSNKYYADSVKG | 185 | SGYALHDDYYGLDV | 122 |
| PI-61 | GFTFSSYGMH | 262 | VISYDGSNKYYADSVKG | 186 | SGYALHDDYYGLDV | 122 |
| H2/L2-22 | GFTFSSYGMH | 262 | VISYHGSNKYYADSVKG | 187 | SGYALHDDYYGLDV | 122 |
| H2/L2-88 | GFTFSSYGMH | 262 | VISYKGSNKYYADSVKG | 188 | SGYALHDDYYGLDV | 122 |
| H2/L2-36 | GFTFSSYGMH | 262 | VISYKGSNKYYADSVKG | 188 | SGYALHDDYYGLDV | 122 |
| H2/L2-34 | GFTFSSYGMH | 262 | VISYTGTKKYYADSVKG | 189 | SGYALHDDYYGLDV | 122 |
| H2/L2-68 | GFTFSSYGMH | 262 | VISYRGFNKYYADSVKG | 190 | SGYALHDDYYGQDV | 199 |
| H2/L2-18 | GFTFSSYGMH | 262 | VISYKGSHKYYADSVKG | 191 | SGYALHDDYYGLDV | 122 |
| H2/L2-47 | GFTFSSYGMH | 262 | VISYKGSNKYYADSVKG | 188 | SGYALHDDYYGLDV | 122 |
| H2/L2-20 | GFTVSSYGMH | 261 | VISYTGSNKYYADSVKG | 185 | SGYALHDDYYGLDV | 122 |
| H2/L2-80 | GFTFSSYGMH | 262 | VISYTGSNKYYADSVKG | 185 | SGYALHDDYYGLDV | 122 |
| H2/L2-83 | GFTFSSYGMH | 262 | VISYKGSNKYYADSVKG | 188 | SGYALHDDYYGLDV | 122 |
| H3-1 | GFTFSSYGMH | 262 | VISYDDAHKYYADSVKG | 192 | SGYALHDQYKPVDV | 200 |
| H3-2 | GFTFSSYGMH | 262 | VISYNDLNKYYADSVKG | 193 | SGYALHDFQDPTDV | 201 |
| H3-3 | GFTVSSYGMH | 261 | VISYSGSNKYYADSVKG | 194 | SGYALHDQYKPVDV | 200 |
| H3-4 | GFTFSSYGMH | 262 | VISYDDAHKYYADSVKG | 192 | SGYALHDQYKPVDV | 200 |
| H3-5 | GFTFSSYGMH | 262 | VISYTGANKYYADSVKG | 195 | SGYNLHDDYYGLDV | 202 |
| H3-6 | GFTFSSYGMH | 262 | VISYDDAHKYYADSVKG | 192 | SGYALHDQYKPVDV | 200 |
| H3-7 | GFTLSSYGMH | 263 | VISYTGSNKYYADSVKG | 185 | SGYEFHEDYYGLDV | 203 |
| H3-8 | GFTFSSYGMH | 262 | VISYDDAHKYYADSVKG | 192 | SGYALHDQYKPVDV | 200 |
| H3-9 | GFTFSSYGMH | 262 | VISYDDAHKYYADSVKG | 192 | SGYALHDQYKPVDV | 200 |
| H3-10 | GFTFSSYGMH | 262 | VISYNDLNKYYADSVKG | 193 | SGYEFQGDYYGLDV | 204 |
| H3-11 | GFTFSSYGMH | 262 | VISYNDANKYYADSVKG | 196 | SGYELRDDYYGLDV | 205 |
| H3-12 | GFTFSSYGMH | 262 | VISYDESNKYYADSVKG | 197 | SGYEVDQDYYGLDV | 206 |

TABLE 11L-2-continued

AB3 family BCMA Binders-Heavy Chain CDR sequences according to combination of Kabat and Chothia numbering schemes

| Binder | CDR-H1 | SEQ ID NO: | CDR-H2: | SEQ ID NO: | CDR-H3 | SEQ ID NO: |
|---|---|---|---|---|---|---|
| H3-13 | GFTFSSYGMH | 262 | VISYDDAHKYYADSVKG | 192 | SGYALHDQYKPVDV | 200 |
| H3-14 | GFTFSSYGMH | 262 | VISYDDAHKYYADSVKG | 192 | SGYALHDQYKPVDV | 200 |
| H3-15 | GFTVSSYGMH | 261 | VISYDDANKYYADSVKG | 198 | SGYAYDGDYYGLDV | 207 |

TABLE 11M-1

AB3 family BCMA Binders- Light Chain CDR sequences according to combination of Kabat and IMGT numbering schemes

| Binder | CDR-L1 | SEQ ID NO: | CDR-L2: | SEQ ID NO: | CDR-L3 | SEQ ID NO: |
|---|---|---|---|---|---|---|
| AB3 | TGTSSDVGGYNYVS | 100 | DVSNRLR | 175 | SSYTSSSALYV | 183 |
| PI-61 | TGTSSDVGGYNYVS | 100 | DVSNRPS | 176 | SSYTSSSTLYV | 184 |
| H2/L2-22 | TGTSSDVGGYNYVS | 100 | EVSNRLS | 177 | SSYTSSSTLYV | 184 |
| H2/L2-88 | TGTSSDVGGYNYVS | 100 | EVSNRLR | 178 | SSYTSSSALYV | 183 |
| H2/L2-36 | TGTSSDVGGYNYVS | 100 | EVSNRLR | 178 | SSYTSSSTLYV | 184 |
| H2/L2-34 | TGTSSDVGGYNYVS | 100 | DVSNRPW | 179 | SSYTSSSALYV | 183 |
| H2/L2-68 | TGTSSDVGGYNYVS | 100 | DVSNRLS | 180 | SSYTSSSTLYV | 184 |
| H2/L2-18 | TGTSSDVGGYNYVS | 100 | DVSNRPW | 179 | SSYTSSSTLYV | 184 |
| H2/L2-47 | TGTSSDVGGYNYVS | 100 | DVSNRPW | 179 | SSYTSSSTLYV | 184 |
| H2/L2-20 | TGTSSDVGGYNYVS | 100 | DVSNRLR | 175 | SSYTSSSALYV | 183 |
| H2/L2-80 | TGTSSDVGGYNYVS | 100 | DVSNRAW | 181 | SSYTSSSALYV | 183 |
| H2/L2-83 | TGTSSDVGGYNYVS | 100 | EVSNRLR | 178 | SSYTSSSTLYV | 184 |
| H3-1 | TGTSSDVGGYNYVS | 100 | EVSNRLR | 178 | SSYTSSSTLYV | 184 |
| H3-2 | TGTSSDVGGYNYVS | 100 | EVSNRLR | 178 | SSYTSSSTLYV | 184 |
| H3-3 | TGTSSDVGGYNYVS | 100 | EVSNRLR | 178 | SSYTSSSTLYV | 184 |
| H3-4 | TGTSSDVGGYNYVS | 100 | EVSNRLR | 178 | SSYTSSSALYV | 183 |
| H3-5 | TGTSSDVGGYNYVS | 100 | EVSNRLS | 177 | SSYTSSSTLYV | 184 |

TABLE 11M-1-continued

AB3 family BCMA Binders- Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| H3-6 | TGTSSDVGGYNYVS | 100 | EVSNRLR | 178 | SSYTSSSALYV | 183 |
| H3-7 | TGTSSDVGGYNYVS | 100 | EVSNRLR | 178 | SSYTSSSTLYV | 184 |
| H3-8 | TGTSSDVGGYNYVS | 100 | EVSNRLR | 178 | SSYTSSSTLYV | 184 |
| H3-9 | TGTSSDVGGYNYVS | 100 | EVSNRLR | 178 | SSYTSSSTLYV | 184 |
| H3-10 | TGTSSDVGGYNYVS | 100 | EVSNRLR | 178 | SSYTSSSTLYV | 184 |
| H3-11 | TGTSSDVGGYNYVS | 100 | EVSNRLR | 178 | SSYTSSSTLYV | 184 |
| H3-12 | TGTSSDVGGYNYVS | 100 | EVSNRLR | 178 | SSYTSSSTLYV | 184 |
| H3-13 | TGTSSDVGGYNYVS | 100 | EVSNRLR | 178 | SSYTSSSTLYV | 184 |
| H3-14 | TGTSSDVGGYNYVS | 100 | EVSNRLS | 177 | SSYTSSSALYV | 183 |
| H3-15 | TGTSSDVGGYNYVS | 100 | EVSNRLG | 182 | SSYTSSSALYV | 183 |

TABLE 11M-2

AB3 family BCMA Binders- Heavy Chain CDR sequences according to combination of Kabat and IMGT numbering schemes

| Binder | CDR-H1 | SEQ ID NO: | CDR-H2: | SEQ ID NO: | CDR-H3 | SEQ ID NO: |
|---|---|---|---|---|---|---|
| AB3 | GFTVSSYGMH | 261 | VISYTGSNKYYADSVKG | 185 | GGSGYALHDDYYGLDV | 124 |
| PI-61 | GFTFSSYGMH | 262 | VISYDGSNKYYADSVKG | 186 | GGSGYALHDDYYGLDV | 124 |
| H2/L2-22 | GFTFSSYGMH | 262 | VISYHGSNKYYADSVKG | 187 | GGSGYALHDDYYGLDV | 124 |
| H2/L2-88 | GFTFSSYGMH | 262 | VISYKGSNKYYADSVKG | 188 | GGSGYALHDDYYGLDV | 124 |
| H2/L2-36 | GFTFSSYGMH | 262 | VISYKGSNKYYADSVKG | 188 | GGSGYALHDDYYGLDV | 124 |
| H2/L2-34 | GFTFSSYGMH | 262 | VISYTGTKKYYADSVKG | 189 | GGSGYALHDDYYGLDV | 124 |
| H2/L2-68 | GFTFSSYGMH | 262 | VISYRGFNKYYADSVKG | 190 | GGSGYALHDDYYGQDV | 252 |
| H2/L2-18 | GFTFSSYGMH | 262 | VISYKGSHKYYADSVKG | 191 | GGSGYALHDDYYGLDV | 124 |
| H2/L2-47 | GFTFSSYGMH | 262 | VISYKGSNKYYADSVKG | 188 | GGSGYALHDDYYGLDV | 124 |

TABLE 11M-2-continued

AB3 family BCMA Binders- Heavy Chain CDR sequences according to combination of Kabat and IMGT numbering schemes

| Binder | CDR-H1 | SEQ ID NO: | CDR-H2: | SEQ ID NO: | CDR-H3 | SEQ ID NO: |
|---|---|---|---|---|---|---|
| H2/L2-20 | GFTVSSYGMH | 261 | VISYTGSNKYYADSVKG | 185 | GGSGYALHDDYYGLDV | 124 |
| H2/L2-80 | GFTFSSYGMH | 262 | VISYTGSNKYYADSVKG | 185 | GGSGYALHDDYYGLDV | 124 |
| H2/L2-83 | GFTFSSYGMH | 262 | VISYKGSNKYYADSVKG | 188 | GGSGYALHDDYYGLDV | 124 |
| H3-1 | GFTFSSYGMH | 262 | VISYDDAHKYYADSVKG | 192 | GGSGYALHDQYKPVDV | 253 |
| H3-2 | GFTFSSYGMH | 262 | VISYNDLNKYYADSVKG | 193 | GGSGYALHDFQDPTDV | 254 |
| H3-3 | GFTVSSYGMH | 261 | VISYSGSNKYYADSVKG | 194 | GGSGYALHDQYKPVDV | 253 |
| H3-4 | GFTFSSYGMH | 262 | VISYDDAHKYYADSVKG | 192 | GGSGYALHDQYKPVDV | 253 |
| H3-5 | GFTFSSYGMH | 262 | VISYTGANKYYADSVKG | 195 | GGSGYNLHDDYYGLDV | 255 |
| H3-6 | GFTFSSYGMH | 262 | VISYDDAHKYYADSVKG | 192 | GGSGYALHDQYKPVDV | 253 |
| H3-7 | GFTLSSYGMH | 263 | VISYTGSNKYYADSVKG | 185 | GGSGYEFHEDYYGLDV | 256 |
| H3-8 | GFTFSSYGMH | 262 | VISYDDAHKYYADSVKG | 192 | GGSGYALHDQYKPVDV | 253 |
| H3-9 | GFTFSSYGMH | 262 | VISYDDAHKYYADSVKG | 192 | GGSGYALHDQYKPVDV | 253 |
| H3-10 | GFTFSSYGMH | 262 | VISYNDLNKYYADSVKG | 193 | GGSGYEFQGDYYGLDV | 257 |
| H3-11 | GFTFSSYGMH | 262 | VISYNDANKYYADSVKG | 196 | GGSGYELRDDYYGLDV | 258 |
| H3-12 | GFTFSSYGMH | 262 | VISYDESNKYYADSVKG | 197 | GGSGYEVDQDYYGLDV | 259 |
| H3-13 | GFTFSSYGMH | 262 | VISYDDAHKYYADSVKG | 192 | GGSGYALHDQYKPVDV | 253 |
| H3-14 | GFTFSSYGMH | 262 | VISYDDAHKYYADSVKG | 192 | GGSGYALHDQYKPVDV | 253 |
| H3-15 | GFTVSSYGMH | 261 | VISYDDANKYYADSVKG | 198 | GGSGYAYDGDYYGLDV | 260 |

TABLE 11N-1(a)

AB3 family BCMA Binders- CDR-L1 and CDR-L3 sequences according to combination of Chothia and IMGT numbering schemes and CDR-L2 expanded sequences

| Binder | CDR-L1 | SEQ ID NO: | CDR-L2 | SEQ ID NO: | CDR-L3 | SEQ ID NO: |
|---|---|---|---|---|---|---|
| AB3 | TSSDVGGYNY | 101 | DVSNRLRGVS | 227 | SSYTSSSALYV | 183 |
| PI-61 | TSSDVGGYNY | 101 | DVSNRPSGVS | 228 | SSYTSSSTLYV | 184 |

119

TABLE 11N-1(a)-continued

AB3 family BCMA Binders- CDR-L1 and CDR-L3 sequences according to combination of Chothia and IMGT numbering schemes and CDR-L2 expanded sequences

| Binder | CDR-L1 | SEQ ID NO: | CDR-L2: | SEQ ID NO: | CDR-L3 | SEQ ID NO: |
|---|---|---|---|---|---|---|
| H2/L2-22 | TSSDVGGYNY | 101 | EVSNRLSGVS | 229 | SSYTSSSTLYV | 184 |
| H2/L2-88 | TSSDVGGYNY | 101 | EVSNRLRGVS | 230 | SSYTSSSALYV | 183 |
| H2/L2-36 | TSSDVGGYNY | 101 | EVSNRLRGVS | 230 | SSYTSSSTLYV | 184 |
| H2/L2-34 | TSSDVGGYNY | 101 | DVSNRPWGVS | 231 | SSYTSSSALYV | 183 |
| H2/L2-68 | TSSDVGGYNY | 101 | DVSNRLSGVS | 232 | SSYTSSSTLYV | 184 |
| H2/L2-18 | TSSDVGGYNY | 101 | DVSNRPWGVS | 231 | SSYTSSSTLYV | 184 |
| H2/L2-47 | TSSDVGGYNY | 101 | DVSNRPWGVS | 231 | SSYTSSSTLYV | 184 |
| H2/L2-20 | TSSDVGGYNY | 101 | DVSNRLRGVS | 227 | SSYTSSSALYV | 183 |
| H2/L2-80 | TSSDVGGYNY | 101 | DVSNRAWGVS | 233 | SSYTSSSALYV | 183 |
| H2/L2-83 | TSSDVGGYNY | 101 | EVSNRLRGVS | 230 | SSYTSSSTLYV | 184 |
| H3-1 | TSSDVGGYNY | 101 | EVSNRLRGVS | 230 | SSYTSSSTLYV | 184 |
| H3-2 | TSSDVGGYNY | 101 | EVSNRLRGVS | 230 | SSYTSSSTLYV | 184 |
| H3-3 | TSSDVGGYNY | 101 | EVSNRLRGVS | 230 | SSYTSSSTLYV | 184 |
| H3-4 | TSSDVGGYNY | 101 | EVSNRLRGVS | 230 | SSYTSSSALYV | 183 |
| H3-5 | TSSDVGGYNY | 101 | EVSNRLSGVS | 229 | SSYTSSSTLYV | 184 |
| H3-6 | TSSDVGGYNY | 101 | EVSNRLRGVS | 230 | SSYTSSSALYV | 183 |
| H3-7 | TSSDVGGYNY | 101 | EVSNRLRGVS | 230 | SSYTSSSTLYV | 184 |
| H3-8 | TSSDVGGYNY | 101 | EVSNRLRGVS | 230 | SSYTSSSTLYV | 184 |
| H3-9 | TSSDVGGYNY | 101 | EVSNRLRGVS | 230 | SSYTSSSTLYV | 184 |
| H3-10 | TSSDVGGYNY | 101 | EVSNRLRGVS | 230 | SSYTSSSTLYV | 184 |
| H3-11 | TSSDVGGYNY | 101 | EVSNRLRGVS | 230 | SSYTSSSTLYV | 184 |
| H3-12 | TSSDVGGYNY | 101 | EVSNRLRGVS | 230 | SSYTSSSTLYV | 184 |
| H3-13 | TSSDVGGYNY | 101 | EVSNRLRGVS | 230 | SSYTSSSTLYV | 184 |
| H3-14 | TSSDVGGYNY | 101 | EVSNRLSGVS | 229 | SSYTSSSALYV | 183 |
| H3-15 | TSSDVGGYNY | 101 | EVSNRLGGVS | 234 | SSYTSSSALYV | 183 |

TABLE 11N-1(b)

AB3 family BCMA Binders- Light Chain CDR sequences according to combination of Chothia and IMGT numbering schemes

| Binder | CDR-L1 | SEQ ID NO: | CDR-L2: | SEQ ID NO: | CDR-L3 | SEQ ID NO: |
|---|---|---|---|---|---|---|
| AB3 | TSSDVGGYNY | 101 | DVS | 105 | SSYTSSSALYV | 183 |
| PI-61 | TSSDVGGYNY | 101 | DVS | 105 | SSYTSSSTLYV | 184 |
| H2/L2-22 | TSSDVGGYNY | 101 | EVS | 208 | SSYTSSSTLYV | 184 |
| H2/L2-88 | TSSDVGGYNY | 101 | EVS | 208 | SSYTSSSALYV | 183 |

120

TABLE 11N-1(b)-continued

AB3 family BCMA Binders- Light Chain CDR sequences according to combination of Chothia and IMGT numbering schemes

| Binder | CDR-L1 | SEQ ID NO: | CDR-L2: | SEQ ID NO: | CDR-L3 | SEQ ID NO: |
|---|---|---|---|---|---|---|
| H2/L2-36 | TSSDVGGYNY | 101 | EVS | 208 | SSYTSSSTLYV | 184 |
| H2/L2-34 | TSSDVGGYNY | 101 | DVS | 105 | SSYTSSSALYV | 183 |
| H2/L2-68 | TSSDVGGYNY | 101 | DVS | 105 | SSYTSSSTLYV | 184 |
| H2/L2-18 | TSSDVGGYNY | 101 | DVS | 105 | SSYTSSSTLYV | 184 |
| H2/L2-47 | TSSDVGGYNY | 101 | DVS | 105 | SSYTSSSTLYV | 184 |
| H2/L2-20 | TSSDVGGYNY | 101 | DVS | 105 | SSYTSSSALYV | 183 |
| H2/L2-80 | TSSDVGGYNY | 101 | DVS | 105 | SSYTSSSALYV | 183 |
| H2/L2-83 | TSSDVGGYNY | 101 | EVS | 208 | SSYTSSSTLYV | 184 |
| H3-1 | TSSDVGGYNY | 101 | EVS | 208 | SSYTSSSTLYV | 184 |
| H3-2 | TSSDVGGYNY | 101 | EVS | 208 | SSYTSSSTLYV | 184 |
| H3-3 | TSSDVGGYNY | 101 | EVS | 208 | SSYTSSSTLYV | 184 |
| H3-4 | TSSDVGGYNY | 101 | EVS | 208 | SSYTSSSALYV | 183 |
| H3-5 | TSSDVGGYNY | 101 | EVS | 208 | SSYTSSSTLYV | 184 |
| H3-6 | TSSDVGGYNY | 101 | EVS | 208 | SSYTSSSALYV | 183 |
| H3-7 | TSSDVGGYNY | 101 | EVS | 208 | SSYTSSSTLYV | 184 |
| H3-8 | TSSDVGGYNY | 101 | EVS | 208 | SSYTSSSTLYV | 184 |
| H3-9 | TSSDVGGYNY | 101 | EVS | 208 | SSYTSSSTLYV | 184 |
| H3-10 | TSSDVGGYNY | 101 | EVS | 208 | SSYTSSSTLYV | 184 |
| H3-11 | TSSDVGGYNY | 101 | EVS | 208 | SSYTSSSTLYV | 184 |
| H3-12 | TSSDVGGYNY | 101 | EVS | 208 | SSYTSSSTLYV | 184 |
| H3-13 | TSSDVGGYNY | 101 | EVS | 208 | SSYTSSSTLYV | 184 |
| H3-14 | TSSDVGGYNY | 101 | EVS | 208 | SSYTSSSALYV | 183 |
| H3-15 | TSSDVGGYNY | 101 | EVS | 208 | SSYTSSSALYV | 183 |

TABLE 11N-2

AB3 family BCMA Binders- Heavy Chain CDR sequences according to combination of Chothia and IMGT numbering schemes

| Binder | CDR-H1 | SEQ ID NO: | CDR-H2: | SEQ ID NO: | CDR-H3 | SEQ ID NO: |
|---|---|---|---|---|---|---|
| AB3 | GFTVSSYG | 235 | ISYTGSNK | 238 | GGSGYALHDDYYGLDV | 124 |
| PI-61 | GFTFSSYG | 236 | ISYDGSNK | 239 | GGSGYALHDDYYGLDV | 124 |
| H2/L2-22 | GFTFSSYG | 236 | ISYHGSNK | 240 | GGSGYALHDDYYGLDV | 124 |
| H2/L2-88 | GFTFSSYG | 236 | ISYKGSNK | 241 | GGSGYALHDDYYGLDV | 124 |

TABLE 11N-2-continued

AB3 family BCMA Binders- Heavy Chain CDR sequences according to combination of Chothia and IMGT numbering schemes

| Binder | CDR-H1 | SEQ ID NO: | CDR-H2: | SEQ ID NO: | CDR-H3 | SEQ ID NO: |
|---|---|---|---|---|---|---|
| H2/L2-36 | GFTFSSYG | 236 | ISYKGSNK | 241 | GGSGYALHDDYYGLDV | 124 |
| H2/L2-34 | GFTFSSYG | 236 | ISYTGTKK | 242 | GGSGYALHDDYYGLDV | 124 |
| H2/L2-68 | GFTFSSYG | 236 | ISYRGFNK | 243 | GGSGYALHDDYYGQDV | 252 |
| H2/L2-18 | GFTFSSYG | 236 | ISYKGSHK | 244 | GGSGYALHDDYYGLDV | 124 |
| H2/L2-47 | GFTFSSYG | 236 | ISYKGSNK | 241 | GGSGYALHDDYYGLDV | 124 |
| H2/L2-20 | GFTVSSYG | 235 | ISYTGSNK | 238 | GGSGYALHDDYYGLDV | 124 |
| H2/L2-80 | GFTFSSYG | 236 | ISYTGSNK | 238 | GGSGYALHDDYYGLDV | 124 |
| H2/L2-83 | GFTFSSYG | 236 | ISYKGSNK | 241 | GGSGYALHDDYYGLDV | 124 |
| H3-1 | GFTFSSYG | 236 | ISYDDAHK | 245 | GGSGYALHDQYKPVDV | 253 |
| H3-2 | GFTFSSYG | 236 | ISYNDLNK | 246 | GGSGYALHDFQDPTDV | 254 |
| H3-3 | GFTVSSYG | 235 | ISYSGSNK | 247 | GGSGYALHDQYKPVDV | 253 |
| H3-4 | GFTFSSYG | 236 | ISYDDAHK | 245 | GGSGYALHDQYKPVDV | 253 |

TABLE 11N-2-continued

AB3 family BCMA Binders- Heavy Chain CDR sequences according to combination of Chothia and IMGT numbering schemes

| Binder | CDR-H1 | SEQ ID NO: | CDR-H2: | SEQ ID NO: | CDR-H3 | SEQ ID NO: |
|---|---|---|---|---|---|---|
| H3-5 | GFTFSSYG | 236 | ISYTGANK | 248 | GGSGYNLHDDYYGLDV | 255 |
| H3-6 | GFTFSSYG | 236 | ISYDDAHK | 245 | GGSGYALHDQYKPVDV | 253 |
| H3-7 | GFTLSSYG | 237 | ISYTGSNK | 238 | GGSGYEFHEDYYGLDV | 256 |
| H3-8 | GFTFSSYG | 236 | ISYDDAHK | 245 | GGSGYALHDQYKPVDV | 253 |
| H3-9 | GFTFSSYG | 236 | ISYDDAHK | 245 | GGSGYALHDQYKPVDV | 253 |
| H3-10 | GFTFSSYG | 236 | ISYNDLNK | 246 | GGSGYEFQGDYYGLDV | 257 |
| H3-11 | GFTFSSYG | 236 | ISYNDANK | 249 | GGSGYELRDDYYGLDV | 258 |
| H3-12 | GFTFSSYG | 236 | ISYDESNK | 250 | GGSGYEVDQDYYGLDV | 259 |
| H3-13 | GFTFSSYG | 236 | ISYDDAHK | 245 | GGSGYALHDQYKPVDV | 253 |
| H3-14 | GFTFSSYG | 236 | ISYDDAHK | 245 | GGSGYALHDQYKPVDV | 253 |
| H3-15 | GFTVSSYG | 235 | ISYDDANK | 251 | GGSGYAYDGDYYGLDV | 260 |

TABLE 11O-1

BCMA Binders - Light chain variable sequences

| Binder | Sequence | SEQ ID NO: |
|---|---|---|
| AB1 | DIQMTQSPSSLSASVGDRVTITCRASQSISSYLNWYQQKPGKAPKLLIYAASSLQSGVPSRFSGSGSGTDFTLTISSLQPEDFATYYCQQSYSSPLTFGQGTKVEIK | 264 |
| AB2 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK | 265 |
| R1F2 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK | 265 |
| PALF03 | DIQMTQSPSSLSASVGDRVTITCRASQSISSYLNWYQQKPGKAPKLLIYAASSLQSGVPSRFSGSGSGTDFTLTISSLQPEDFATYYCQQSYGSPPTFGQGTKVEIK | 266 |
| PALF04 | DIQMTQSPSSLSASVGDRVTITCRASQSISSYLNWYQQKPGKAPKLLIYAASSLQSGVPSRFSGSGSGTDFTLTISSLQPEDFATYYCQQSYDSPLTFGQGTKVEIK | 267 |
| PALF05 | DIQMTQSPSSLSASVGDRVTITCRASQSISSYLNWYQQKPGKAPKLLIYAASSLQSGVPSRFSGSGSGTDFTLTISSLQPEDFATYYCQQSYYSPLTFGQGTKVEIK | 268 |
| PALF06 | DIQMTQSPSSLSASVGDRVTITCRASQSISSYLNWYQQKPGKAPKLLIYAASSLQSGVPSRFSGSGSGTDFTLTISSLQPEDFATYYCQQSYYAPLTFGQGTKVEIK | 269 |
| PALF07 | DIQMTQSPSSLSASVGDRVTITCRASQSISSYLNWYQQKPGKAPKLLIYAASSLQSGVPSRFSGSGSGTDFTLTISSLQPEDFATYYCQQSYASPLTFGQGTKVEIK | 270 |
| PALF08 | DIQMTQSPSSLSASVGDRVTITCRASQSISSYLNWYQQKPGKAPKLLIYAASSLQSGVPSRFSGSGSGTDFTLTISSLQPEDFATYYCQQSYGSPLTFGQGTKVEIK | 271 |

TABLE 110-1-continued

| BCMA Binders - Light chain variable sequences | | |
| --- | --- | --- |
| Binder | Sequence | SEQ ID NO: |
| PALF09 | DIQMTQSPSSLSASVGDRVTITCRASQSISSYLNWYQQKPGKAPKLLIYAASSLQ SGVPSRFSGSGSGTDFTLTISSLQPEDFATYYCQQSYDAPLTFGQGTKVEIK | 272 |
| PALF12 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF13 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF14 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF15 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF16 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF17 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF18 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF19 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| PALF20 | DIQMTQSPSSLSASVGDRVTITCRASQSISSYLNWYQQKPGKAPKLLIYAASSLQ SGVPSRFSGSGSGTDFTLTISSLQPEDFATYYCQQSYSTPLTFGQGTKVEIK | 265 |
| AB3 | QSALTQPASVSGSPGQSITISCTGTSSDVGGYNYVSWYQQHPGKAPKLMIYDVS NRLRGVSNRFSGSKSGNTASLTISGLQAEDEADYYCSSYTSSSALYVFGSGTKV TVL | 273 |
| PI-61 | QSALTQPASVSGSPGQSITISCTGTSSDVGGYNYVSWYQQHPGKAPKLMIYDVS NRPSGVSNRFSGSKSGNTASLTISGLQAEDEADYYCSSYTSSSTLYVFGSGTKV TVL | 274 |
| H2/L2-22 | QSALTQPASVSGSPGQSITISCTGTSSDVGGYNYVSWYQQHPGKAPKLMIYEVS NRLSGVSNRFSGSKFGNTASLTISGLQAEDEADYYCSSYTSSSTLYVFGSGTKVT VL | 275 |
| H2/L2-88 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSALYVFGSGTKV TVL | 276 |
| H2/L2-36 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H2/L2-34 | QSALTQPASVSGSPGQSITISCTGTSSDVGGYNYVSWYQQHPGKAPKLMIYDVS NRPWGVSNRFSGSKFGNTASLTISGLQAEDEADYYCSSYTSSSALYVFGSGTKV TVM | 278 |
| H2/L2-68 | QSALTQPASVSGSPGQSITISCTGTSSDVGGYNYVSWYQQHPGKAPKLMIYDVS NRLSGVSNRFSGSKFGNTASLTISGLQAEDEADYYCSSYTSSSTLYVFGSGTKVT VL | 279 |
| H2/L2-18 | QSALTQPASVSGSPGQSITISCTGTSSDVGGYNYVSWYQQHPGKAPKLMIYDVS NRPWGVSNRFSGSKFGNTASLTISGLQAEDEADYYCSSYTSSSTLYVFGSGTKV TVL | 280 |
| H2/L2-47 | QSALTQPASVSGSPGQSITISCTGTSSDVGGYNYVSWYQQHPGKAPKLMIYDVS NRPWGVSNRFSGSKFGNTASLTISGLQAEDEADYYCSSYTSSSTLYVFGSGTKV TVL | 280 |
| H2/L2-20 | QSALTQPASVSGSPGQSITISCTGTSSDVGGYNYVSWYQQHPGKAPKLMIYDVS NRLRGVSNRFSGSKFGNTASLTISGLQAEDEADYYCSSYTSSSALYVFGSGTKV TVL | 281 |
| H2/L2-80 | QSALTQPASVSGSPGQSITISCTGTSSDVGGYNYVSWYQQHPGKAPKLMIYDVS NRAWGVSNRFSGSKFGNTASLTISGLQAEDEADYYCSSYTSSSALYVFGSGTKV TVL | 282 |

TABLE 11O-1-continued

| BCMA Binders - Light chain variable sequences | | |
|---|---|---|
| Binder | Sequence | SEQ ID NO: |
| H2/L2-83 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-1 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-2 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-3 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-4 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSALYVFGSGTKV TVL | 276 |
| H3-5 | QSALTQPASVSGSPGQSITISCTGTSSDVGGYNYVSWYQQHPGKAPKLMIYEVS NRLSGVSNRFSGSKFGNTASLTISGLQAEDEADYYCSSYTSSSTLYVFGSGTKVT VL | 275 |
| H3-6 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSALYVFGSGTKV TVL | 276 |
| H3-7 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-8 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-9 | QSALTQPASVSGSPGQSITISCTGTSSDVGGYNYVSWYQQHPGKAPKLMIYEVS NRLRGVSNRFSGSKFGNTASLTISGLQAEDEAYYYCSSYTSSSTLYVFGSGTKVT VL | 283 |
| H3-10 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-11 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-12 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-13 | QSALTQPASVSGSPGQSITISCTGTSSDVGGYNYVSWYQQHPGKAPKLMIYEVS NRLRGVSNRFSGSKFGNTASLTISGLQAEDEADYYCSSYTSSSTLYVFGSGTKVT VL | 277 |
| H3-14 | QSALTQPASVSGSPGQSITISCTGTSSDVGGYNYVSWYQQHPGKAPKLMIYEVS NRLSGVSNRFSGSKFGNTASLTISGLQAEDEADYYCSSYTSSSALYVFGSGTKV TVL | 284 |
| H3-15 | QSALTQPASVSGSPGQSITISCTGTSSDVGGYNYVSWYQQHPGKAPKLMIYEVS NRLGGVSNRFSGSKFGNTASLTISGLQAEDEADYYCSSYTSSSALYVFGSGTKV TVL | 285 |

TABLE 110-2

| | BCMA Binders - Heavy chain variable sequences | |
|---|---|---|
| Binder | Sequence | SEQ ID NO: |
| AB1 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| AB2 | EVQLLESGGGLVQPGGSLRLSCAASGFTFSSYAMSWVRQAPGKGLEWVSAISE SGGRAAYADSVKGRFTISRDNSKNTLYLQMNSLRAEDTAVYYCARREWWYDD WYLDYWGQGTLVTVSS | 287 |
| R1F2 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF03 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF04 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF05 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF06 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF07 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF08 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF09 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCARREWWYDDW YLDYWGQGTLVTVSS | 286 |
| PALF12 | EVQLLESGGGLVQPGGSLRLSCAASGFTFSSYAMSWVRQAPGKGLEWVSAISG SGGRAAYADSVKGRFTISRDNSKNTLYLQMNSLRAEDTAVYYCARREWWYDD WYLDYWGQGTLVTVSS | 288 |
| PALF13 | EVQLLESGGGLVQPGGSLRLSCAASGFTFSSYAMSWVRQAPGKGLEWVSAISE SGDVEAYADSVKGRFTISRDNSKNTLYLQMNSLRAEDTAVYYCARREWWYDDW YLDYWGQGTLVTVSS | 289 |
| PALF14 | EVQLLESGGGLVQPGGSLRLSCAASGFTFSSYAMSWVRQAPGKGLEWVSAISE AGETTSYADSVKGRFTISRDNSKNTLYLQMNSLRAEDTAVYYCARREWWYDDW YLDYWGQGTLVTVSS | 290 |
| PALF15 | EVQLLESGGGLVQPGGSLRLSCAASGFTFSSYAMSWVRQAPGKGLEWVSAISE HGHYTSYADSVKGRFTISRDNSKNTLYLQMNSLRAEDTAVYYCARREWWYDDW YLDYWGQGTLVTVSS | 291 |
| PALF16 | EVQLLESGGGLVQPGGSLRLSCAASGFTFSSYAMSWVRQAPGKGLEWVSAISG SGHTAAYADSVKGRFTISRDNSKNTLYLQMNSLRAEDTAVYYCARREWWYDDW YLDYWGQGTLVTVSS | 292 |
| PALF17 | EVQLLESGGGLVQPGGSLRLSCAASGFTFSSYAMSWVRQAPGKGLEWVSAISG SGRTHAYADSVKGRFTISRDNSKNTLYLQMNSLRAEDTAVYYCARREWWYDDW YLDYWGQGTLVTVSS | 293 |
| PALF18 | EVQLLESGGGLVQPGGSLRLSCAASGFTFSSYAMSWVRQAPGKGLEWVSAISA EGGVRAYADSVKGRFTISRDNSKNTLYLQMNSLRAEDTAVYYCARREWWYDD WYLDYWGQGTLVTVSS | 294 |
| PALF19 | EVQLLESGGGLVQPGGSLRLSCAASGFTFSSYAMSWVRQAPGKGLEWVSAISG SGGTTAYADSVKGRFTISRDNSKNTLYLQMNSLRAEDTAVYYCARREWWYDDW YLDYWGQGTLVTVSS | 295 |

TABLE 110-2-continued

BCMA Binders - Heavy chain variable sequences

| Binder | Sequence | SEQ ID NO: |
|---|---|---|
| PALF20 | EVQLLESGGGLVQPGGSLRLSCAASGFTFSSYAMSWVRQAPGKGLEWVSAISG SGATTAYADSVKGRFTISRDNSKNTLYLQMNSLRAEDTAVYYCARREWWYDDW YLDYWGQGTLVTVSS | 296 |
| AB3 | QVQLVESGGGWVQPGRSLRLSCAASGFTVSSYGMHWVRQAPGKGLEWVAVIS YTGSNKYYADSVKGRFTISRDNSKNTLYLQMNSLRAEDTAVYYCGGSGYALHDD YYGLDVWGQGTLVTVSS | 297 |
| PI-61 | QVQLQESGGGVVQPGRSLRLSCAASGFTFSSYGMHWVRQAPGKGLEVWVAVIS YDGSNKYYADSVKGRFTISRDNSKNTLYLQMNSLRAEDTAVYYCGGSGYALHDD YYGLDVWGQGTLVTVSS | 298 |
| H2/L2-22 | QAQLQSSEGGVVQPGRSLRLSCAASGFTFSSYGMHWVRQAPGKGLEWVAVIS YHGSNKYYADSVKGRFTISRDNSKNTLYLQMNSLRAEDTAVYYCGGSGYALHDD YYGLDVWGQGTLVTVSSS | 299 |
| H2/L2-88 | QVQLQSSEGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSS | 300 |
| H2/L2-36 | QAQLQSSGGGVVQPGRSLRLSCAASGFTFSSYGMHWVRQAPGKGLEVWVAVIS YKGSNKYYADSVKGRFTISRDNSKNTLYLQMNSLRAEDTAVYYCGGSGYALHDD YYGLDVWGQGTLVTVSS | 301 |
| H2/L2-34 | QVQLQDSEGGWQPGRSLRLSCAASGFTFSSYGMHWVRQAPGKGLEWVAVIS YTGTKKYYADSVKGRFTISRDNSKNTLYLQMNSLRAEDTAVYYCGGSGYALHDD YYGLDVWGQGTLVTVSS | 302 |
| H2/L2-68 | QAQLQSSEGGVVQPGRSLRLSCAASGFTFSSYGMHWVRQAPGKGLEWVAVIS YRGFNKYYADSVKGRFTISRDNSKNTLYLQMNSLRAEDTAVYYCGGSGYALHDD YYGQDVWGQGTLVTVSS | 303 |
| H2/L2-18 | QAQLQGSGGGVVQPGRSLRLSCAASGFTFSSYGMHWVRQAPGKGLEWVAVIS YKGSHKYYADSVKGRFTISRDNSKNTLYLQMNSLRAEDTAVYYCGGSGYALHDD YYGLDVWGQGTLVTVSS | 304 |
| H2/L2-47 | QVQLQSSEGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSS | 300 |
| H2/L2-20 | QAQLQSSGGGVVQPGRSLRLSCAASGFTVSSYGMHWVRQAPGKGLEWVAVIS YTGSNKYYADSVKGRFTISRDNSKNTLYLQMNSLRAEDTAVYYCGGSGYALHDD YYGLDVWGQGTLVTVSS | 305 |
| H2/L2-80 | QVQLQSSGGGVVQPGRSLRLSCAASGFTFSSYGMHWVRQAPGKGLEWVAVIS YTGSNKYYADSVKGRFTISRDNSKNTLYLQMNSLRAEDTAVYYCGGSGYALHDD YYGLDVWGQGTLVTVSS | 306 |
| H2/L2-83 | QAQLQGSGGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSS | 307 |
| H3-1 | QVQLQGSGGGVVQPGRSLRLSCAASGFTFSSYGMHWVRQAPGKGLEWVAVIS YDDAHKYYADSVKGRFTISRDNSKNTLYLQMNSLRAEDTAVYYCGGSGYALHDQ YKPVDVWGQGTLVTVSS | 308 |
| H3-2 | QAQLQESEGGWVQPGGSLRLSCAASGFTFSSYGMHWVRQAPGKGLEWVAVIS YNDLNKYYADSVKGRFTISRDNSKNTLYLQMNSLRAEDTAVYYCGGSGYALHDF QDPTDVWGQGTLVTVSS | 309 |
| H3-3 | QVQLQSSGGGVVQPGRSLRLSCAASGFTVSSYGMHWVRQAPGKGLEWVAVIS YSGSNKYYADSVKGRFTISRDNSKNTLYLQMNSLRAEDTAVYYCGGSGYALHDQ YKPVDVWGQGTLVTVSS | 310 |
| H3-4 | QVQLQGSGGGVVQPGRSLRLSCAASGFTFSSYGMHWVRQAPGKGLEWVAVIS YDDAHKYYADSVKGRFTISRDNSKNTLYLQMNSLRAEDTAVYYCGGSGYALHDQ YKPVDVWGQGTLVTVSS | 308 |
| H3-5 | QVQLQGSGGGVVQPGRSLRLSCAASGFTFSSYGMHWVRQAPGKGLEWVAVIS YTGANKYYADSVKGRFTISRDNSKNTLYLQMNSLRAEDTAVYYCGGSGYNLHDD YYGLDVWGQGTLVTVSS | 311 |

TABLE 11O-2-continued

| | BCMA Binders - Heavy chain variable sequences | |
|---|---|---|
| Binder | Sequence | SEQ ID NO: |
| H3-6 | QAQLQRSGGGVVQPGRSLRLSCAASGFTFSSYGMHWVRQAPGKGLEWVAVIS YDDAHKYYADSVKGRFTISRDNSKNTLYLQMNSLRAEDTAVYYCGGSGYALHDQ YKPVDVWGQGTLVTVSS | 312 |
| H3-7 | QVQLQSSEGGVVQPGRSLRLSCAASGFTLSSYGMHWVRQAPGKGLEWVAVIS YTGSNKYYADSVKGRFTISRDNSKNTLYLQMNSLRAEDTAVYYCGGSGYEFHED YYGLDVWGQGTLVTVSS | 313 |
| H3-8 | QAQLQGSEGGVVQPGRSLRLSCAASGFTFSSYGMHWVRQAPGKGLEVWVAVIS YDDAHKYYADSVKGRFTISRDNSKNTLYLQMNSLRAEDTAVYYCGGSGYALHDQ YKPVDVWGQGTLVTVSS | 314 |
| H3-9 | QVQLQGSGGGVVQPGRSLRLSCAASGFTFSSYGMHWVRQAPGKGLEWVAVIS YDDAHKYYADSVKGRFTISRDNSKNTLYLQMNSLRAEDTAVYYCGGSGYALHDQ YKPVDVWGQGTLVTVSS | 308 |
| H3-10 | QVQLQSSGGGVVQPGRSLRLSCAASGFTFSSYGMHWVRQAPGKGLEVWVAVIS YNDLNKYYADSVKGRFTISRDNSKNTLYLQMNSLRAEDTAVYYCGGSGYEFQGD YYGLDVWGQGTLVTVSS | 315 |
| H3-11 | QVQLQSSEGGVVQPGRSLRLSCAASGFTFSSYGMHWVRQAPGKGLEWVAVIS YNDANKYYADSVKGRFTISRDNSKNTLYLQMNSLRAEDTAVYYCGGSGYELRDD YYGLDVWGQGTLVTVSS | 316 |
| H3-12 | QAQLQSSEGGVVQPGRSLRLSCAASGFTFSSYGMHWVRQAPGKGLEWVAVIS YDESNKYYADSVKGRFTISRDNSKNTLYLQMNSLRAEDTAVYYCGGSGYEVDQ DYYGLDVWGQGTLVTVSS | 317 |
| H3-13 | QVQLQESGGGVVQPGRSLRLSCAASGFTFSSYGMHWVRQAPGKGLEVWVAVIS YDDAHKYYADSVKGRFTISRDNSKNTLYLQMNSLRAEDTAVYYCGGSGYALHDQ YKPVDVWGQGTLVTVSS | 318 |
| H3-14 | QVQLQGSGGGVVQPGRSLRLSCAASGFTFSSYGMHWVRQAPGKGLEWVAVIS YDDAHKYYADSVKGRFTISRDNSKNTLYLQMNSLRAEDTAVYYCGGSGYALHDQ YKPVDVWGQGTLVTVSS | 308 |
| H3-15 | QVQLQGSGGGVVQPGRSLRLSCAASGFTVSSYGMHWVRQAPGKGLEWVAVIS YDDANKYYADSVKGRFTISRDSSKNTLYLQMNSLRAEDTAVYYCGGSGYAYDG DYYGLDVWGQGTLVTVSS | 319 |

TABLE 11P

| | BCMA Binders - scFv sequences | |
|---|---|---|
| Binder | Sequence | SEQ ID NO: |
| H2/L2-88 | QVQLQSSEGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYEVSNRLRGVSNRFSGS KFGNTASLTISGLQAEDEADYYCSSYTSSSALYVFGSGTKVTVL | 320 |
| H2/L2-36 | QAQLQSSGGGVVQPGRSLRLSCAASGFTFSSYGMHWWRQAPGKGLEVWVAVIS YKGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYEVSNRLRGVSNRFSGS KFGNTASLTISGLQAEDEADYYCSSYTSSSTLYVFGSGTKVTVL | 321 |
| H2/L2-34 | QVQLQDSEGGWQPGRSLRLSCAASGFTFSSYGMHWVRQAPGKGLEWVAVIS YTGTKKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYDVSNRPWGVSNRFSG SKFGNTASLTISGLQAEDEADYYCSSYTSSSALYVFGSGTKVTVM | 322 |
| H2/L2-68 | QAQLQSSEGGVVQPGRSLRLSCAASGFTFSSYGMHWVRQAPGKGLEWVAVIS YRGFNKYYADSVKGRFTISRDNSKNTLYLQMNSLRAEDTAVYYCGGSGYALHDD YYGQDVWGQGTLVTVSSSGGGGSGGGGSGGGGSGGGGSQSALTQPASVSGS PGQSITISCTGTSSDVGGYNYVSWYQQHPGKAPKLMIYDVSNRLSGVSNRFSGS KFGNTASLTISGLQAEDEADYYCSSYTSSSTLYVFGSGTKVTVL | 323 |

TABLE 11P-continued

| BCMA Binders - scFv sequences | | |
|---|---|---|
| Binder | Sequence | SEQ ID NO: |
| H2/L2-18 | QAQLQGSGGGVVQPGRSLRLSCAASGFTFSSYGMHWVRQAPGKGLEWVAVIS YKGSHKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYDVSNRPWGVSNRFSG SKFGNTASLTISGLQAEDEADYYCSSYTSSSTLYVFGSGTKVTVL | 324 |
| H2/L2-47 | QVQLQSSEGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYDVSNRPWGVSNRFSG SKFGNTASLTISGLQAEDEADYYCSSYTSSSTLYVFGSGTKVTVL | 325 |
| H2/L2-20 | QAQLQSSGGGVVQPGRSLRLSCAASGFTVSSYGMHWVRQAPGKGLEWVAVIS YTGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYDVSNRLRGVSNRFSGS KFGNTASLTISGLQAEDEADYYCSSYTSSSALYVFGSGTKVTVL | 326 |
| H2/L2-80 | QVQLQSSGGGVVQPGRSLRLSCAASGFTFSSYGMHWWRQAPGKGLEWVVAVIS YTGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYDVSNRAWGVSNRFSG SKFGNTASLTISGLQAEDEADYYCSSYTSSSALYVFGSGTKVTVL | 327 |
| H2/L2-83 | QAQLQGSGGGVVQPGRSLRLSCAASGFTFSSYGMHWVRQAPGKGLEWVAVIS YKGSNKYYADSVKGRFTISRDNSKNTLYLQMNSLRAEDTAVYYCGGSGYALHDD YYGLDVWGQGTLVTVSSSGGGGSGGGGSGGGGSGGGGSQSALTQPASVSGS PGQSITISCTGTSSDVGGYNYVSWYQQHPGKAPKLMIYEVSNRLRGVSNRFSGS KFGNTASLTISGLQAEDEADYYCSSYTSSSTLYVFGSGTKVTVL | 328 |

Tables 11A-1 to 11B-2 list CDR consensus sequences derived from the CDR sequences of exemplary BCMA binding molecules. The CDR consensus sequences include sequences based upon the Kabat CDR sequences of the exemplary BCMA binding molecules, the Chothia CDR sequences of the exemplary BCMA binding molecules, the IMGT CDR sequences of the exemplary BCMA binding molecules, a combination of the Kabat and Chothia CDR sequences of the exemplary BCMA binding molecules, a combination of the Kabat and IMGT CDR sequences of the exemplary BCMA binding molecules, and a combination of the Chothia and IMGT CDR sequences of the exemplary BCMA binding molecules. The specific CDR sequences of the exemplary BCMA binding molecules are listed in Tables 11C1-11N-2. Exemplary VL and VH sequences are listed in Tables 11O-1 and 11O-2, respectively. Exemplary scFv sequences are listed in Table 11P.

In some embodiments, ABM1 comprises a light chain CDR having an amino acid sequence of any one of the CDR consensus sequences listed in Table 11A-1 or Table 11B-1. In particular embodiments, the present disclosure provides MBMs comprising an ABM1 that comprises (or alternatively, consists of) one, two, three, or more light chain CDRs selected from the light chain CDRs described in Table 11A-1 or Table 11B-1.

In some embodiments, ABM1 comprises a heavy chain CDR having an amino acid sequence of any one of the heavy chain CDRs listed in Table 11A-2 or Table 11B-2. In particular embodiments, the present disclosure provides MBMs comprising an ABM1 comprising (or alternatively, consisting of) one, two, three, or more heavy chain CDRs selected from the heavy chain CDRs described in Table 11A-2 or Table 11B-2.

In some embodiments, ABM1 comprises CDR-L1, CDR-L2, CDR-L3, CDR-H1, CDR-H2 and CDR-H3 sequences of C1 as set forth in Tables 11A-1 and 11A-2. In some embodiments, ABM1 comprises CDR-L1, CDR-L2, CDR-L3, CDR-H1, CDR-H2 and CDR-H3 sequences of C2 as set forth in Tables 11A-1 and 11A-2. In some embodiments, ABM1 comprises CDR-L1, CDR-L2, CDR-L3, CDR-H1, CDR-H2 and CDR-H3 sequences of C3 as set forth in Tables 11A-1 and 11A-2. In some embodiments, ABM1 comprises CDR-L1, CDR-L2, CDR-L3, CDR-H1, CDR-H2 and CDR-H3 sequences of C4 as set forth in Tables 11A-1 and 11A-2. In some embodiments, ABM1 comprises CDR-L1, CDR-L2, CDR-L3, CDR-H1, CDR-H2 and CDR-H3 sequences of C5 as set forth in Tables 11A-1 and 11A-2. In some embodiments, ABM1 comprises CDR-L1, CDR-L2, CDR-L3, CDR-H1, CDR-H2 and CDR-H3 sequences of C6 as set forth in Tables 11A-1 and 11A-2. In some embodiments, ABM1 comprises CDR-L1, CDR-L2, CDR-L3, CDR-H1, CDR-H2 and CDR-H3 sequences of C7 as set forth in Tables 11A-1 and 11A-2. In some embodiments, ABM1 comprises CDR-L1, CDR-L2, CDR-L3, CDR-H1, CDR-H2 and CDR-H3 sequences of C8 as set forth in Tables 11A-1 and 11A-2. In some embodiments, ABM1 comprises CDR-L1, CDR-L2, CDR-L3, CDR-H1, CDR-H2 and CDR-H3 sequences of C9 as set forth in Tables 11A-1 and 11A-2. In some embodiments, ABM1 comprises CDR-L1, CDR-L2, CDR-L3, CDR-H1, CDR-H2 and CDR-H3 sequences of O10 as set forth in Tables 11A-1 and 11A-2. In some embodiments, ABM1 comprises CDR-L1, CDR-L2, CDR-L3, CDR-H1, CDR-H2 and CDR-H3 sequences of O11 as set forth in Tables 11A-1 and 11A-2. In some embodiments, ABM1 comprises CDR-L1, CDR-L2, CDR-L3, CDR-H1, CDR-H2 and CDR-H3 sequences of C12 as set forth in Tables 11A-1 and 11A-2.

In some embodiments, ABM1 comprises CDR-L1, CDR-L2, CDR-L3, CDR-H1, CDR-H2 and CDR-H3 sequences of C13 as set forth in Tables 11B-1 and 11B-2. In some embodiments, ABM1 comprises CDR-L1, CDR-L2, CDR-L3, CDR-H1, CDR-H2 and CDR-H3 sequences of C14 as set forth in Tables 11B-1 and 11B-2. In some embodiments, ABM1 comprises CDR-L1, CDR-L2, CDR-L3, CDR-H1, CDR-H2 and CDR-H3 sequences of C15 as set forth in Tables 11B-1 and 11B-2. In some embodiments, ABM1 comprises CDR-L1, CDR-L2, CDR-L3, CDR-H1, CDR-H2 and CDR-H3 sequences of C16 as set forth in Tables 11B-1 and 11B-2. In some embodiments, ABM1 comprises CDR-L1, CDR-L2, CDR-L3, CDR-H1, CDR-H2 and CDR-H3 sequences of C17 as set forth in Tables 11B-1 and 11B-2. In some embodiments, ABM1 comprises CDR-L1, CDR-L2, CDR-L3, CDR-H1, CDR-H2 and CDR-H3 sequences of C18 as set forth in Tables 11B-1 and 11B-2. In some embodiments, ABM1 comprises CDR-L1, CDR-L2, CDR-L3, CDR-H1, CDR-H2 and CDR-H3 sequences of C19 as set forth in Tables 11B-1 and 11B-2. In some embodiments, ABM1 comprises CDR-L1, CDR-L2, CDR-L3, CDR-H1, CDR-H2 and CDR-H3 sequences of C20 as set forth in Tables 11B-1 and 11B-2. In some embodiments, ABM1 comprises CDR-L1, CDR-L2, CDR-L3, CDR-H1, CDR-H2 and CDR-H3 sequences of C21 as set forth in Tables 11B-1 and 11B-2. In some embodiments, ABM1 comprises CDR-L1, CDR-L2, CDR-L3, CDR-H1, CDR-H2 and CDR-H3 sequences of C22 as set forth in Tables 11B-1 and 11B-2. In some embodiments, ABM1 comprises CDR-L1, CDR-L2, CDR-L3, CDR-H1, CDR-H2 and CDR-H3 sequences of C23 as set forth in Tables 11B-1 and 11B-2. In some embodiments, ABM1 comprises CDR-L1, CDR-L2, CDR-L3, CDR-H1, CDR-H2 and CDR-H3 sequences of C24 as set forth in Tables 11B-1 and 11B-2. In some embodiments, ABM1 comprises CDR-L1, CDR-L2, CDR-L3, CDR-H1, CDR-H2 and CDR-H3 sequences of C25 as set forth in Tables 11B-1 and 11B-2. In some embodiments, ABM1 comprises CDR-L1, CDR-L2, CDR-L3, CDR-H1, CDR-H2 and CDR-H3 sequences of C26 as set forth in Tables 11B-1 and 11B-2. In some embodiments, ABM1 comprises CDR-L1, CDR-L2, CDR-L3, CDR-H1, CDR-H2 and CDR-H3 sequences of C27 as set forth in Tables 11B-1 and 11B-2. In some embodiments, ABM1 comprises CDR-L1, CDR-L2, CDR-L3, CDR-H1, CDR-H2 and CDR-H3 sequences of C28 as set forth in Tables 11B-1 and 11B-2.

In some embodiments, ABM1 comprises a light chain CDR having an amino acid sequence of any one of the CDRs listed in Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a) or Table 11N-1(b). In particular embodiments, ABM1 comprises light chain CDRs comprising (or alternatively, consisting of) one, two, three, or more light chain CDRs selected the light chain CDRs described in Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a) and Table 11N-1(b).

In some embodiments, ABM1 comprises a heavy chain CDR having an amino acid sequence of any one of the heavy chain CDRs listed in Table 11C-2, Table 11D-2, Table 11E-2, Table 11F-2, Table 11G-2, Table 11H-2, Table 11I-2, Table 11J-2, Table 11K-2, Table 11L-2, Table 11M-2, or Table 11N-2. In particular embodiments, ABM1 comprises heavy chain CDRs comprising (or alternatively, consisting of) one, two, three, or more heavy chain CDRs selected the heavy chain CDRs described in Table 11C-2, Table 11D-2, Table 11E-2, Table 11F-2, Table 11G-2, Table 11H-2, Table 11I-2, Table 11J-2, Table 11K-2, Table 11L-2, Table 11M-2, and Table 11N-2.

In some embodiments, ABM1 comprises a VL domain having an amino acid sequence of any VL domain described in Table 11O-1. In other embodiments, ABM1 can include amino acids that have been mutated, yet have at least 80, 85, 90, 95, 96, 97, 98, or 99 percent identity in the VL domain with the VL domains depicted in the sequences described in Table 11O-1.

In some embodiments, ABM1 comprises a VH domain having an amino acid sequence of any VH domain described in Table 11O-2. In other embodiments, ABM1 can include amino acids that have been mutated, yet have at least 80, 85, 90, 95, 96, 97, 98, or 99 percent identity in the VH domain with the VH domains depicted in the sequences described in Table 11O-2.

In other embodiments, ABM1 includes amino acids that have been mutated, yet have at least 80, 85, 90, 95, 96, 97, 98, or 99 percent identity in the CDR regions with the CDR sequences described in Table 11. In some embodiments, such ABMs include mutant amino acid sequences where no more than 1, 2, 3, 4 or 5 amino acids have been mutated in the CDR regions when compared with the CDR sequences described in Table 11.

Other ABMs include VH and/or VL domains comprising amino acid sequences having at least 80, 85, 90, 95, 96, 97, 98, or 99 percent identity to the VH and/or VL sequences described in Table 11. In some embodiments, ABM1 includes VH and/or VL domains where no more than 1, 2, 3, 4 or 5 amino acids have been mutated when compared with the VH and/or VL domains depicted in the sequences described in Table 11, while retaining substantially the same therapeutic activity.

VH and VL sequences (amino acid sequences and the nucleotide sequences encoding the amino acid sequences) can be "mixed and matched" to create other BCMA binding ABMs. Such "mixed and matched" BCMA binding ABMs can be tested using known binding assays (e.g., ELISAs). When chains are mixed and matched, a VH sequence from a particular VH/VL pairing should be replaced with a structurally similar VH sequence. A VL sequence from a particular VH/VL pairing should be replaced with a structurally similar VL sequence.

Accordingly, in one embodiment, the present disclosure provides MBMs having an ABM1 comprising: a heavy chain variable region (VH) comprising an amino acid sequence selected from any one of the VH sequences described in Table 11-O2; and a light chain variable region (VL) comprising an amino acid sequence described in Table 11-O1.

In another embodiment, the present disclosure provides MBMs having an ABM1 comprising a CDR-H1 as described in Table 11, a CDR-H2 as described in Table 11, a CDR-H3 as described in Table 11, a CDR-L1 as described in Table 11, a CDR-L2 as described in Table 11, and a CDR-L3 as described in Table 11.

In some embodiments, ABM1 comprises CDR-L1, CDR-L2, CDR-L3, CDR-H1, CDR-H2 and CDR-H3 sequences of AB1 as set forth in Tables 11C-1 and 11C-2. In some embodiments, ABM1 comprises CDR-L1, CDR-L2, CDR-L3, CDR-H1, CDR-H2 and CDR-H3 sequences of AB1 as set forth in Tables 11D-1 and 11D-2. In some embodiments, ABM1 comprises CDR-L1, CDR-L2, CDR-L3, CDR-H1, CDR-H2 and CDR-H3 sequences of AB1 as set forth in Tables 11E-1 and 11E-2. In some embodiments, ABM1 comprises CDR-L1, CDR-L2, CDR-L3, CDR-H1, CDR-H2 and CDR-H3 sequences of AB1 as set forth in Tables 11F-1 and 11F-2. In some embodiments, ABM1 comprises CDR-L1, CDR-L2, CDR-L3, CDR-H1, CDR-H2 and CDR-H3 sequences of AB1 as set forth in Tables 11G-1 and 11G-2. In some embodiments, ABM1 comprises CDR-L1, CDR-L2, CDR-L3, CDR-H1, CDR-H2 and CDR-H3 sequences of AB1 as set forth in Tables 11H-1 and 11H-2.

In some embodiments, ABM1 comprises CDR-L1, CDR-L2, CDR-L3, CDR-H1, CDR-H2 and CDR-H3 sequences of AB2 as set forth in Tables 11C-1 and 11C-2. In some embodiments, ABM1 comprises CDR-L1, CDR-L2, CDR-L3, CDR-H1, CDR-H2 and CDR-H3 sequences of AB2 as set forth in Tables 11D-1 and 11D-2. In some embodiments, ABM1 comprises CDR-L1, CDR-L2, CDR-L3, CDR-H1, CDR-H2 and CDR-H3 sequences of AB2 as set forth in Tables 11E-1 and 11E-2. In some embodiments, ABM1 comprises CDR-L1, CDR-L2, CDR-L3, CDR-H1, CDR-H2 and CDR-H3 sequences of AB2 as set forth in Tables 11F-1 and 11F-2. In some embodiments, ABM1 comprises CDR-L1, CDR-L2, CDR-L3, CDR-H1, CDR-H2 and CDR-H3 sequences of AB2 as set forth in Tables 11G-1 and 11G-2. In some embodiments, ABM1 comprises CDR-L1, CDR-L2, CDR-L3, CDR-H1, CDR-H2 and CDR-H3 sequences of AB2 as set forth in Tables 11H-1 and 11H-2.

In some embodiments, ABM1 comprises CDR-L1, CDR-L2, CDR-L3, CDR-H1, CDR-H2 and CDR-H3 sequences of R1F2 as set forth in Tables 11C-1 and 11C-2. In some embodiments, ABM1 comprises CDR-L1, CDR-L2, CDR-L3, CDR-H1, CDR-H2 and CDR-H3 sequences of R1F2 as set forth in Tables 11D-1 and 11D-2. In some embodiments, ABM1 comprises CDR-L1, CDR-L2, CDR-L3, CDR-H1, CDR-H2 and CDR-H3 sequences of R1F2 as set forth in Tables 11E-1 and 11E-2. In some embodiments, ABM1 comprises CDR-L1, CDR-L2, CDR-L3, CDR-H1, CDR-H2 and CDR-H3 sequences of R1F2 as set forth in Tables 11F-1 and 11F-2. In some embodiments, ABM1 comprises CDR-L1, CDR-L2, CDR-L3, CDR-H1, CDR-H2 and CDR-H3 sequences of R1F2 as set forth in Tables 11G-1 and 11G-2. In some embodiments, ABM1 comprises CDR-L1, CDR-L2, CDR-L3, CDR-H1, CDR-H2 and CDR-H3 sequences of R1F2 as set forth in Tables 11H-1 and 11H-2.

In some embodiments, ABM1 comprises CDR-L1, CDR-L2, CDR-L3, CDR-H1, CDR-H2 and CDR-H3 sequences of PALF03 as set forth in Tables 11C-1 and 11C-2. In some embodiments, ABM1 comprises CDR-L1, CDR-L2, CDR-L3, CDR-H1, CDR-H2 and CDR-H3 sequences of PALF03 as set forth in Tables 11D-1 and 11D-2. In some embodiments, ABM1 comprises CDR-L1, CDR-L2, CDR-L3, CDR-H1, CDR-H2 and CDR-H3 sequences of PALF03 as set forth in Tables 11E-1 and 11E-2. In some embodiments, ABM1 comprises CDR-L1, CDR-L2, CDR-L3, CDR-H1, CDR-H2 and CDR-H3 sequences of PALF03 as set forth in Tables 11F-1 and 11F-2. In some embodiments, ABM1 comprises CDR-L1, CDR-L2, CDR-L3, CDR-H1, CDR-H2 and CDR-H3 sequences of PALF03 as set forth in Tables 11G-1 and 11G-2. In some embodiments, ABM1 comprises CDR-L1, CDR-L2, CDR-L3, CDR-H1, CDR-H2 and CDR-H3 sequences of PALF03 as set forth in Tables 11H-1 and 11H-2.

In some embodiments, ABM1 comprises CDR-L1, CDR-L2, CDR-L3, CDR-H1, CDR-H2 and CDR-H3 sequences of PALF04 as set forth in Tables 11C-1 and 11C-2. In some embodiments, ABM1 comprises CDR-L1, CDR-L2, CDR-L3, CDR-H1, CDR-H2 and CDR-H3 sequences of PALF04 as set forth in Tables 11D-1 and 11D-2. In some embodiments, ABM1 comprises CDR-L1, CDR-L2, CDR-L3, CDR-H1, CDR-H2 and CDR-H3 sequences of PALF04 as set forth in Tables 11E-1 and 11E-2. In some embodiments, ABM1 comprises CDR-L1, CDR-L2, CDR-L3, CDR-H1, CDR-H2 and CDR-H3 sequences of PALF04 as set forth in Tables 11F-1 and 11F-2. In some embodiments, ABM1 comprises CDR-L1, CDR-L2, CDR-L3, CDR-H1, CDR-H2 and CDR-H3 sequences of PALF04 as set forth in Tables 11G-1 and 11G-2. In some embodiments, ABM1 comprises CDR-L1, CDR-L2, CDR-L3, CDR-H1, CDR-H2 and CDR-H3 sequences of PALF04 as set forth in Tables 11H-1 and 11H-2.

In some embodiments, ABM1 comprises CDR-L1, CDR-L2, CDR-L3, CDR-H1, CDR-H2 and CDR-H3 sequences of PALF05 as set forth in Tables 11C-1 and 11C-2. In some embodiments, ABM1 comprises CDR-L1, CDR-L2, CDR-L3, CDR-H1, CDR-H2 and CDR-H3 sequences of PALF05 as set forth in Tables 11D-1 and 11D-2. In some embodiments, ABM1 comprises CDR-L1, CDR-L2, CDR-L3, CDR-H1, CDR-H2 and CDR-H3 sequences of PALF05 as set forth in Tables 11E-1 and 11E-2. In some embodiments, ABM1 comprises CDR-L1, CDR-L2, CDR-L3, CDR-H1, CDR-H2 and CDR-H3 sequences of PALF05 as set forth in Tables 11F-1 and 11F-2. In some embodiments, ABM1 comprises CDR-L1, CDR-L2, CDR-L3, CDR-H1, CDR-H2 and CDR-H3 sequences of PALF05 as set forth in Tables 11G-1 and 11G-2. In some embodiments, ABM1 comprises CDR-L1, CDR-L2, CDR-L3, CDR-H1, CDR-H2 and CDR-H3 sequences of PALF05 as set forth in Tables 11H-1 and 11H-2.

In some embodiments, ABM1 comprises CDR-L1, CDR-L2, CDR-L3, CDR-H1, CDR-H2 and CDR-H3 sequences of PALF06 as set forth in Tables 11C-1 and 11C-2. In some embodiments, ABM1 comprises CDR-L1, CDR-L2, CDR-L3, CDR-H1, CDR-H2 and CDR-H3 sequences of PALF06 as set forth in Tables 11D-1 and 11D-2. In some embodiments, ABM1 comprises CDR-L1, CDR-L2, CDR-L3, CDR-H1, CDR-H2 and CDR-H3 sequences of PALF06 as set forth in Tables 11E-1 and 11E-2. In some embodiments, ABM1 comprises CDR-L1, CDR-L2, CDR-L3, CDR-H1, CDR-H2 and CDR-H3 sequences of PALF06 as set forth in Tables 11F-1 and 11F-2. In some embodiments, ABM1 comprises CDR-L1, CDR-L2, CDR-L3, CDR-H1, CDR-H2 and CDR-H3 sequences of PALF06 as set forth in Tables 11G-1 and 11G-2. In some embodiments, ABM1 comprises CDR-L1, CDR-L2, CDR-L3, CDR-H1, CDR-H2 and CDR-H3 sequences of PALF06 as set forth in Tables 11H-1 and 11H-2.

In some embodiments, ABM1 of comprises CDR-L1, CDR-L2, CDR-L3, CDR-H1, CDR-H2 and CDR-H3 sequences of PALF07 as set forth in Tables 11C-1 and 11C-2. In some embodiments, ABM1 comprises CDR-L1, CDR-L2, CDR-L3, CDR-H1, CDR-H2 and CDR-H3 sequences of PALF07 as set forth in Tables 11D-1 and 11D-2. In some embodiments, ABM1 comprises CDR-L1, CDR-L2, CDR-L3, CDR-H1, CDR-H2 and CDR-H3 sequences of PALF07 as set forth in Tables 11E-1 and 11E-2. In some embodiments, ABM1 comprises CDR-L1, CDR-L2, CDR-L3, CDR-H1, CDR-H2 and CDR-H3 sequences of PALF07 as set forth in Tables 11F-1 and 11F-2. In some embodiments, ABM1 comprises CDR-L1, CDR-L2, CDR-L3, CDR-H1, CDR-H2 and CDR-H3 sequences of PALF07 as set forth in Tables 11G-1 and 11G-2. In some embodiments, ABM1 comprises CDR-L1, CDR-L2, CDR-L3, CDR-H1, CDR-H2 and CDR-H3 sequences of PALF07 as set forth in Tables 11H-1 and 11H-2.

In some embodiments, ABM1 comprises CDR-L1, CDR-L2, CDR-L3, CDR-H1, CDR-H2 and CDR-H3 sequences of PALF08 as set forth in Tables 11C-1 and 11C-2. In some embodiments, ABM1 comprises CDR-L1, CDR-L2, CDR-L3, CDR-H1, CDR-H2 and CDR-H3 sequences of PALF08 as set forth in Tables 11D-1 and 11D-2. In some embodiments, ABM1 comprises CDR-L1, CDR-L2, CDR-L3, CDR-H1, CDR-H2 and CDR-H3 sequences of PALF08 as set forth in Tables 11E-1 and 11E-2. In some embodiments, ABM1 comprises CDR-L1, CDR-L2, CDR-L3, CDR-H1, CDR-H2 and CDR-H3 sequences of PALF08 as set forth in Tables 11F-1 and 11F-2. In some embodiments, ABM1 comprises CDR-L1, CDR-L2, CDR-L3, CDR-H1, CDR-H2 and CDR-H3 sequences of PALF08 as set forth in Tables 11G-1 and 11G-2. In some embodiments, ABM1 comprises CDR-L1, CDR-L2, CDR-L3, CDR-H1, CDR-H2 and CDR-H3 sequences of PALF08 as set forth in Tables 11H-1 and 11H-2.

In some embodiments, ABM1 comprises CDR-L1, CDR-L2, CDR-L3, CDR-H1, CDR-H2 and CDR-H3 sequences of PALF09 as set forth in Tables 11C-1 and 11C-2. In some embodiments, ABM1 comprises CDR-L1, CDR-L2, CDR-L3, CDR-H1, CDR-H2 and CDR-H3 sequences of PALF09 as set forth in Tables 11D-1 and 11D-2. In some embodiments, ABM1 comprises CDR-L1, CDR-L2, CDR-L3, CDR-H1, CDR-H2 and CDR-H3 sequences of PALF09 as set forth in Tables 11E-1 and 11E-2. In some embodiments, ABM1 comprises CDR-L1, CDR-L2, CDR-L3, CDR-H1, CDR-H2 and CDR-H3 sequences of PALF09 as set forth in Tables 11F-1 and 11F-2. In some embodiments, ABM1 comprises CDR-L1, CDR-L2, CDR-L3, CDR-H1, CDR-H2 and CDR-H3 sequences of PALF09 as set forth in Tables 11G-1 and 11G-2. In some embodiments, ABM1 comprises CDR-L1, CDR-L2, CDR-L3, CDR-H1, CDR-H2 and CDR-H3 sequences of PALF09 as set forth in Tables 11H-1 and 11H-2.

In some embodiments, ABM1 comprises CDR-L1, CDR-L2, CDR-L3, CDR-H1, CDR-H2 and CDR-H3 sequences of PALF12 as set forth in Tables 11C-1 and 11C-2. In some embodiments, ABM1 comprises CDR-L1, CDR-L2, CDR-L3, CDR-H1, CDR-H2 and CDR-H3 sequences of PALF12 as set forth in Tables 11D-1 and 11D-2. In some embodiments, ABM1 comprises CDR-L1, CDR-L2, CDR-L3, CDR-H1, CDR-H2 and CDR-H3 sequences of PALF12 as set forth in Tables 11E-1 and 11E-2. In some embodiments, ABM1 comprises CDR-L1, CDR-L2, CDR-L3, CDR-H1, CDR-H2 and CDR-H3 sequences of PALF12 as set forth in Tables 11F-1 and 11F-2. In some embodiments, ABM1 comprises CDR-L1, CDR-L2, CDR-L3, CDR-H1, CDR-H2 and CDR-H3 sequences of PALF12 as set forth in Tables 11G-1 and 11G-2. In some embodiments, ABM1 comprises CDR-L1, CDR-L2, CDR-L3, CDR-H1, CDR-H2 and CDR-H3 sequences of PALF12 as set forth in Tables 11H-1 and 11H-2.

In some embodiments, ABM1 comprises CDR-L1, CDR-L2, CDR-L3, CDR-H1, CDR-H2 and CDR-H3 sequences of PALF13 as set forth in Tables 11C-1 and 11C-2. In some embodiments, ABM1 comprises CDR-L1, CDR-L2, CDR-L3, CDR-H1, CDR-H2 and CDR-H3 sequences of PALF13 as set forth in Tables 11D-1 and 11D-2. In some embodiments, ABM1 comprises CDR-L1, CDR-L2, CDR-L3, CDR-H1, CDR-H2 and CDR-H3 sequences of PALF13 as set forth in Tables 11E-1 and 11E-2. In some embodiments, ABM1 comprises CDR-L1, CDR-L2, CDR-L3, CDR-H1, CDR-H2 and CDR-H3 sequences of PALF13 as set forth in Tables 11F-1 and 11F-2. In some embodiments, ABM1 comprises CDR-L1, CDR-L2, CDR-L3, CDR-H1, CDR-H2 and CDR-H3 sequences of PALF13 as set forth in Tables 11G-1 and 11G-2. In some embodiments, ABM1 comprises CDR-L1, CDR-L2, CDR-L3, CDR-H1, CDR-H2 and CDR-H3 sequences of PALF13 as set forth in Tables 11H-1 and 11H-2.

In some embodiments, ABM1 comprises CDR-L1, CDR-L2, CDR-L3, CDR-H1, CDR-H2 and CDR-H3 sequences of PALF14 as set forth in Tables 11C-1 and 11C-2. In some embodiments, ABM1 comprises CDR-L1, CDR-L2, CDR-L3, CDR-H1, CDR-H2 and CDR-H3 sequences of PALF14 as set forth in Tables 11D-1 and 11D-2. In some embodiments, ABM1 comprises CDR-L1, CDR-L2, CDR-L3, CDR-H1, CDR-H2 and CDR-H3 sequences of PALF14 as set forth in Tables 11E-1 and 11E-2. In some embodiments, ABM1 comprises CDR-L1, CDR-L2, CDR-L3, CDR-H1, CDR-H2 and CDR-H3 sequences of PALF14 as set forth in Tables 11F-1 and 11F-2. In some embodiments, ABM1 comprises CDR-L1, CDR-L2, CDR-L3, CDR-H1, CDR-H2 and CDR-H3 sequences of PALF14 as set forth in Tables 11G-1 and 11G-2. In some embodiments, ABM1 comprises CDR-L1, CDR-L2, CDR-L3, CDR-H1, CDR-H2 and CDR-H3 sequences of PALF14 as set forth in Tables 11H-1 and 11H-2.

In some embodiments, ABM1 comprises CDR-L1, CDR-L2, CDR-L3, CDR-H1, CDR-H2 and CDR-H3 sequences of PALF15 as set forth in Tables 11C-1 and 11C-2. In some embodiments, ABM1 comprises CDR-L1, CDR-L2, CDR-L3, CDR-H1, CDR-H2 and CDR-H3 sequences of PALF15 as set forth in Tables 11D-1 and 11D-2. In some embodiments, ABM1 comprises CDR-L1, CDR-L2, CDR-L3, CDR-H1, CDR-H2 and CDR-H3 sequences of PALF15 as set forth in Tables 11E-1 and 11E-2. In some embodiments, ABM1 comprises CDR-L1, CDR-L2, CDR-L3, CDR-H1, CDR-H2 and CDR-H3 sequences of PALF15 as set forth in Tables 11F-1 and 11F-2. In some embodiments, ABM1 comprises CDR-L1, CDR-L2, CDR-L3, CDR-H1, CDR-H2 and CDR-H3 sequences of PALF15 as set forth in Tables 11G-1 and 11G-2. In some embodiments, ABM1 comprises CDR-L1, CDR-L2, CDR-L3, CDR-H1, CDR-H2 and CDR-H3 sequences of PALF15 as set forth in Tables 11H-1 and 11H-2.

In some embodiments, ABM1 comprises CDR-L1, CDR-L2, CDR-L3, CDR-H1, CDR-H2 and CDR-H3 sequences of PALF16 as set forth in Tables 11C-1 and 11C-2. In some embodiments, ABM1 comprises CDR-L1, CDR-L2, CDR-L3, CDR-H1, CDR-H2 and CDR-H3 sequences of PALF16 as set forth in Tables 11D-1 and 11D-2. In some embodiments, ABM1 comprises CDR-L1, CDR-L2, CDR-L3, CDR-H1, CDR-H2 and CDR-H3 sequences of PALF16 as set forth in Tables 11E-1 and 11E-2. In some embodiments, ABM1 comprises CDR-L1, CDR-L2, CDR-L3, CDR-H1, CDR-H2 and CDR-H3 sequences of PALF16 as set forth in Tables 11F-1 and 11F-2. In some embodiments, ABM1 comprises CDR-L1, CDR-L2, CDR-L3, CDR-H1, CDR-H2 and CDR-H3 sequences of PALF16 as set forth in Tables 11G-1 and 11G-2. In some embodiments, ABM1 comprises CDR-L1, CDR-L2, CDR-L3, CDR-H1, CDR-H2 and CDR-H3 sequences of PALF16 as set forth in Tables 11H-1 and 11H-2.

In some embodiments, ABM1 comprises CDR-L1, CDR-L2, CDR-L3, CDR-H1, CDR-H2 and CDR-H3 sequences of PALF17 as set forth in Tables 11C-1 and 11C-2. In some embodiments, ABM1 comprises CDR-L1, CDR-L2, CDR-L3, CDR-H1, CDR-H2 and CDR-H3 sequences of PALF17 as set forth in Tables 11D-1 and 11D-2. In some embodiments, ABM1 comprises CDR-L1, CDR-L2, CDR-L3, CDR-H1, CDR-H2 and CDR-H3 sequences of PALF17 as set forth in Tables 11E-1 and 11E-2. In some embodiments, ABM1 comprises CDR-L1, CDR-L2, CDR-L3, CDR-H1, CDR-H2 and CDR-H3 sequences of PALF17 as set forth in Tables 11F-1 and 11F-2. In some embodiments, ABM1 comprises CDR-L1, CDR-L2, CDR-L3, CDR-H1, CDR-H2 and CDR-H3 sequences of PALF17 as set forth in Tables 11G-1 and 11G-2. In some embodiments, ABM1 comprises CDR-L1, CDR-L2, CDR-L3, CDR-H1, CDR-H2 and CDR-H3 sequences of PALF17 as set forth in Tables 11H-1 and 11H-2.

In some embodiments, ABM1 comprises CDR-L1, CDR-L2, CDR-L3, CDR-H1, CDR-H2 and CDR-H3 sequences of PALF18 as set forth in Tables 11C-1 and 11C-2. In some embodiments, ABM1 comprises CDR-L1, CDR-L2, CDR-L3, CDR-H1, CDR-H2 and CDR-H3 sequences of PALF18 as set forth in Tables 11D-1 and 11D-2. In some embodiments, ABM1 comprises CDR-L1, CDR-L2, CDR-L3, CDR-H1, CDR-H2 and CDR-H3 sequences of PALF18 as set forth in Tables 11E-1 and 11E-2. In some embodiments, ABM1 comprises CDR-L1, CDR-L2, CDR-L3, CDR-H1, CDR-H2 and CDR-H3 sequences of PALF18 as set forth in Tables 11F-1 and 11F-2. In some embodiments, ABM1 comprises CDR-L1, CDR-L2, CDR-L3, CDR-H1, CDR-H2 and CDR-H3 sequences of PALF18 as set forth in Tables 11G-1 and 11G-2. In some embodiments, ABM1 comprises CDR-L1, CDR-L2, CDR-L3, CDR-H1, CDR-H2 and CDR-H3 sequences of PALF18 as set forth in Tables 11H-1 and 11H-2.

In some embodiments, ABM1 comprises CDR-L1, CDR-L2, CDR-L3, CDR-H1, CDR-H2 and CDR-H3 sequences of PALF19 as set forth in Tables 11C-1 and 11C-2. In some embodiments, ABM1 comprises CDR-L1, CDR-L2, CDR-L3, CDR-H1, CDR-H2 and CDR-H3 sequences of PALF19 as set forth in Tables 11D-1 and 11D-2. In some embodiments, ABM1 comprises CDR-L1, CDR-L2, CDR-L3, CDR-H1, CDR-H2 and CDR-H3 sequences of PALF19 as set forth in Tables 11E-1 and 11E-2. In some embodiments, ABM1 comprises CDR-L1, CDR-L2, CDR-L3, CDR-H1, CDR-H2 and CDR-H3 sequences of PALF19 as set forth in Tables 11F-1 and 11F-2. In some embodiments, ABM1 comprises CDR-L1, CDR-L2, CDR-L3, CDR-H1, CDR-H2 and CDR-H3 sequences of PALF19 as set forth in Tables 11G-1 and 11G-2. In some embodiments, ABM1 comprises CDR-L1, CDR-L2, CDR-L3, CDR-H1, CDR-H2 and CDR-H3 sequences of PALF19 as set forth in Tables 11H-1 and 11H-2.

In some embodiments, ABM1 comprises CDR-L1, CDR-L2, CDR-L3, CDR-H1, CDR-H2 and CDR-H3 sequences of PALF20 as set forth in Tables 11C-1 and 11C-2. In some embodiments, ABM1 comprises CDR-L1, CDR-L2, CDR-L3, CDR-H1, CDR-H2 and CDR-H3 sequences of PALF20 as set forth in Tables 11D-1 and 11D-2. In some embodiments, ABM1 comprises CDR-L1, CDR-L2, CDR-L3, CDR-H1, CDR-H2 and CDR-H3 sequences of PALF20 as set forth in Tables 11E-1 and 11E-2. In some embodiments, ABM1 comprises CDR-L1, CDR-L2, CDR-L3, CDR-H1, CDR-H2 and CDR-H3 sequences of PALF20 as set forth in Tables 11F-1 and 11F-2. In some embodiments, ABM1 comprises CDR-L1, CDR-L2, CDR-L3, CDR-H1, CDR-H2 and CDR-H3 sequences of PALF20 as set forth in Tables 11G-1 and 11G-2. In some embodiments, ABM1 comprises CDR-L1, CDR-L2, CDR-L3, CDR-H1, CDR-H2 and CDR-H3 sequences of PALF20 as set forth in Tables 11H-1 and 11H-2.

In some embodiments, ABM1 comprises CDR-L1, CDR-L2, CDR-L3, CDR-H1, CDR-H2 and CDR-H3 sequences of AB3 as set forth in Tables 11I-1 and 11I-2. In some embodiments, ABM1 comprises CDR-L1, CDR-L2, CDR-L3, CDR-H1, CDR-H2 and CDR-H3 sequences of AB3 as set forth in Tables 11J-1 and 11J-2. In some embodiments, ABM1 comprises CDR-L1, CDR-L2, CDR-L3, CDR-H1, CDR-H2 and CDR-H3 sequences of AB3 as set forth in Tables 11K-1 and 11K-2. In some embodiments, ABM1 comprises CDR-L1, CDR-L2, CDR-L3, CDR-H1, CDR-H2 and CDR-H3 sequences of AB3 as set forth in Tables 11L-1 and 11L-2. In some embodiments, ABM1 comprises CDR-L1, CDR-L2, CDR-L3, CDR-H1, CDR-H2 and CDR-H3 sequences of AB3 as set forth in Tables 11M-1 and 11M-2. In some embodiments, ABM1 comprises CDR-L1, CDR-L2, CDR-L3, CDR-H1, CDR-H2 and CDR-H3 sequences of AB3 as set forth in Tables 11N-1 and 11N-2.

In some embodiments, ABM1 comprises CDR-L1, CDR-L2, CDR-L3, CDR-H1, CDR-H2 and CDR-H3 sequences of PI-61 as set forth in Tables 11I-1 and 11I-2. In some embodiments, ABM1 comprises CDR-L1, CDR-L2, CDR-L3, CDR-H1, CDR-H2 and CDR-H3 sequences of 61 as set forth in Tables 11J-1 and 11J-2. In some embodiments, ABM1 comprises CDR-L1, CDR-L2, CDR-L3, CDR-H1, CDR-H2 and CDR-H3 sequences of PI-61 as set forth in Tables 11K-1 and 11K-2. In some embodiments, ABM1 comprises CDR-L1, CDR-L2, CDR-L3, CDR-H1, CDR-H2 and CDR-H3 sequences of PI-61 as set forth in Tables 11L-1 and 11L-2. In some embodiments, ABM1 comprises CDR-L1, CDR-L2, CDR-L3, CDR-H1, CDR-H2 and CDR-H3 sequences of PI-61 as set forth in Tables 11M-1 and 11M-2. In some embodiments, ABM1 comprises CDR-L1, CDR-L2, CDR-L3, CDR-H1, CDR-H2 and CDR-H3 sequences of PI-61 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-22 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-22 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-22 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-22 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-22 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-22 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-88 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-88 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-88 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-88 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-88 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-88 as set forth in Tables 11N-1 and 11N-2.

In some embodiments, ABM1 of comprises CDR-L1, CDR-L2, CDR-L3, CDR-H1, CDR-H2 and CDR-H3 sequences of H2/L2-36 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-36 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-36 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-36 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-36 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-36 as set forth in Tables 11N-1 and 11N-2.

In some embodiments, ABM1 of comprises CDR-L1, CDR-L2, CDR-L3, CDR-H1, CDR-H2 and CDR-H3 sequences of H2/L2-34 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-34 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-34 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-34 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-34 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-34 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-68 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-68 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-68 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-68 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-68 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-68 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-18 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-18 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-18 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-18 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-18 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-18 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-47 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-47 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-47 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-47 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-47 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-47 as set forth in Tables 11N-1 and 11N-2.

In some embodiments, ABM1 of comprises CDR-L1, CDR-L2, CDR-L3, CDR-H1, CDR-H2 and CDR-H3 sequences of H2/L2-20 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-20 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-20 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-20 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-20 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-20 as set forth in Tables 11N-1 and 11N-2.

In some embodiments, ABM1 comprises CDR-L1, CDR-L2, CDR-L3, CDR-H1, CDR-H2 and CDR-H3 sequences of H2/L2-80 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-80 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-80 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-80 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-80 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-80 as set forth in Tables 11N-1 and 11N-2.

In some embodiments, ABM1 comprises CDR-L1, CDR-L2, CDR-L3, CDR-H1, CDR-H2 and CDR-H3 sequences of H2L2-83 as set forth in Tables 11I-1 and 11I-2. In some embodiments, ABM1 comprises CDR-L1, CDR-L2, CDR-L3, CDR-H1, CDR-H2 and CDR-H3 sequences of H2/L2-83 as set forth in Tables 11J-1 and 11J-2. In some embodiments, ABM1 comprises CDR-L1, CDR-L2, CDR-L3, CDR-H1, CDR-H2 and CDR-H3 sequences of H2/L2-83 as set forth in Tables 11K-1 and 11K-2. In some embodiments, ABM1 comprises CDR-L1, CDR-L2, CDR-L3, CDR-H1, CDR-H2 and CDR-H3 sequences of H2/L2-83 as set forth in Tables 11L-1 and 11L-2. In some embodiments, ABM1 comprises CDR-L1, CDR-L2, CDR-L3, CDR-H1, CDR-H2 and CDR-H3 sequences of H2/L2-83 as set forth in Tables 11M-1 and 11M-2. In some embodiments, ABM1 comprises CDR-L1, CDR-L2, CDR-L3, CDR-H1, CDR-H2 and CDR-H3 sequences of H2/L2-83 as set forth in Tables 11N-1 and 11N-2.

In some embodiments, ABM1 comprises CDR-L1, CDR-L2, CDR-L3, CDR-H1, CDR-H2 and CDR-H3 sequences of H3-1 as set forth in Tables 11I-1 and 11I-2. In some embodiments, ABM1 comprises CDR-L1, CDR-L2, CDR-L3, CDR-H1, CDR-H2 and CDR-H3 sequences of H3-1 as set forth in Tables 11J-1 and 11J-2. In some embodiments, ABM1 comprises CDR-L1, CDR-L2, CDR-L3, CDR-H1, CDR-H2 and CDR-H3 sequences of H3-1 as set forth in Tables 11K-1 and 11K-2. In some embodiments, ABM1 comprises CDR-L1, CDR-L2, CDR-L3, CDR-H1, CDR-H2 and CDR-H3 sequences of H3-1 as set forth in Tables 11L-1 and 11L-2. In some embodiments, ABM1 comprises CDR-L1, CDR-L2, CDR-L3, CDR-H1, CDR-H2 and CDR-H3 sequences of H3-1 as set forth in Tables 11M-1 and 11M-2. In some embodiments, ABM1 comprises CDR-L1, CDR-L2, CDR-L3, CDR-H1, CDR-H2 and CDR-H3 sequences of H3-1 as set forth in Tables 11N-1 and 11N-2.

In some embodiments, ABM1 comprises CDR-L1, CDR-L2, CDR-L3, CDR-H1, CDR-H2 and CDR-H3 sequences of H3-2 as set forth in Tables 11I-1 and 11I-2. In some embodiments, ABM1 comprises CDR-L1, CDR-L2, CDR-L3, CDR-H1, CDR-H2 and CDR-H3 sequences of H3-2 as set forth in Tables 11J-1 and 11J-2. In some embodiments, ABM1 comprises CDR-L1, CDR-L2, CDR-L3, CDR-H1, CDR-H2 and CDR-H3 sequences of H3-2 as set forth in Tables 11K-1 and 11K-2. In some embodiments, ABM1 comprises CDR-L1, CDR-L2, CDR-L3, CDR-H1, CDR-H2 and CDR-H3 sequences of H3-2 as set forth in Tables 11L-1 and 11L-2. In some embodiments, ABM1 comprises CDR-L1, CDR-L2, CDR-L3, CDR-H1, CDR-H2 and CDR-H3 sequences of H3-2 as set forth in Tables 11M-1 and 11M-2. In some embodiments, ABM1 comprises CDR-L1, CDR-L2, CDR-L3, CDR-H1, CDR-H2 and CDR-H3 sequences of H3-2 as set forth in Tables 11N-1 and 11N-2.

In some embodiments, ABM1 of comprises CDR-L1, CDR-L2, CDR-L3, CDR-H1, CDR-H2 and CDR-H3 sequences of H3-3 as set forth in Tables 11I-1 and 11I-2. In some embodiments, ABM1 comprises CDR-L1, CDR-L2, CDR-L3, CDR-H1, CDR-H2 and CDR-H3 sequences of H3-3 as set forth in Tables 11J-1 and 11J-2. In some embodiments, ABM1 comprises CDR-L1, CDR-L2, CDR-L3, CDR-H1, CDR-H2 and CDR-H3 sequences of H3-3 as set forth in Tables 11K-1 and 11K-2. In some embodiments, ABM1 comprises CDR-L1, CDR-L2, CDR-L3, CDR-H1, CDR-H2 and CDR-H3 sequences of H3-3 as set forth in Tables 11L-1 and 11L-2. In some embodiments, ABM1 comprises CDR-L1, CDR-L2, CDR-L3, CDR-H1, CDR-H2 and CDR-H3 sequences of H3-3 as set forth in Tables 11M-1 and 11M-2. In some embodiments, ABM1 comprises CDR-L1, CDR-L2, CDR-L3, CDR-H1, CDR-H2 and CDR-H3 sequences of H3-3 as set forth in Tables 11N-1 and 11N-2.

In some embodiments, ABM1 of comprises CDR-L1, CDR-L2, CDR-L3, CDR-H1, CDR-H2 and CDR-H3 sequences of H3-4 as set forth in Tables 11I-1 and 11I-2. In some embodiments, ABM1 comprises CDR-L1, CDR-L2, CDR-L3, CDR-H1, CDR-H2 and CDR-H3 sequences of H3-4 as set forth in Tables 11J-1 and 11J-2. In some embodiments, ABM1 comprises CDR-L1, CDR-L2, CDR- L3, CDR-H1, CDR-H2 and CDR-H3 sequences of H3-4 as set forth in Tables 11K-1 and 11K-2. In some embodiments, ABM1 comprises CDR-L1, CDR-L2, CDR-L3, CDR-H1, CDR-H2 and CDR-H3 sequences of H3-4 as set forth in Tables 11L-1 and 11L-2. In some embodiments, ABM1 comprises CDR-L1, CDR-L2, CDR-L3, CDR-H1, CDR-H2 and CDR-H3 sequences of H3-4 as set forth in Tables 11M-1 and 11M-2. In some embodiments, ABM1 comprises CDR-L1, CDR-L2, CDR-L3, CDR-H1, CDR-H2 and CDR-H3 sequences of H3-4 as set forth in Tables 11N-1 and 11N-2.

In some embodiments, ABM1 comprises CDR-L1, CDR-L2, CDR-L3, CDR-H1, CDR-H2 and CDR-H3 sequences of H3-5 as set forth in Tables 11I-1 and 11I-2. In some embodiments, ABM1 comprises CDR-L1, CDR-L2, CDR-L3, CDR-H1, CDR-H2 and CDR-H3 sequences of H3-5 as set forth in Tables 11J-1 and 11J-2. In some embodiments, ABM1 comprises CDR-L1, CDR-L2, CDR-L3, CDR-H1, CDR-H2 and CDR-H3 sequences of H3-5 as set forth in Tables 11K-1 and 11K-2. In some embodiments, ABM1 comprises CDR-L1, CDR-L2, CDR-L3, CDR-H1, CDR-H2 and CDR-H3 sequences of H3-5 as set forth in Tables 11L-1 and 11L-2. In some embodiments, ABM1 comprises CDR-L1, CDR-L2, CDR-L3, CDR-H1, CDR-H2 and CDR-H3 sequences of H3-5 as set forth in Tables 11M-1 and 11M-2. In some embodiments, ABM1 comprises CDR-L1, CDR-L2, CDR-L3, CDR-H1, CDR-H2 and CDR-H3 sequences of H3-5 as set forth in Tables 11N-1 and 11N-2.

In some embodiments, ABM1 comprises CDR-L1, CDR-L2, CDR-L3, CDR-H1, CDR-H2 and CDR-H3 sequences of H3-6 as set forth in Tables 11I-1 and 11I-2. In some embodiments, ABM1 comprises CDR-L1, CDR-L2, CDR-L3, CDR-H1, CDR-H2 and CDR-H3 sequences of H3-6 as set forth in Tables 11J-1 and 11J-2. In some embodiments, ABM1 comprises CDR-L1, CDR-L2, CDR-L3, CDR-H1, CDR-H2 and CDR-H3 sequences of H3-6 as set forth in Tables 11K-1 and 11K-2. In some embodiments, ABM1 comprises CDR-L1, CDR-L2, CDR-L3, CDR-H1, CDR-H2 and CDR-H3 sequences of H3-6 as set forth in Tables 11L-1 and 11L-2. In some embodiments, ABM1 comprises CDR-L1, CDR-L2, CDR-L3, CDR-H1, CDR-H2 and CDR-H3 sequences of H3-6 as set forth in Tables 11M-1 and 11M-2. In some embodiments, ABM1 comprises CDR-L1, CDR-L2, CDR-L3, CDR-H1, CDR-H2 and CDR-H3 sequences of H3-6 as set forth in Tables 11N-1 and 11N-2.

In some embodiments, ABM1 comprises CDR-L1, CDR-L2, CDR-L3, CDR-H1, CDR-H2 and CDR-H3 sequences of H3-7 as set forth in Tables 11I-1 and 11I-2. In some embodiments, ABM1 comprises CDR-L1, CDR-L2, CDR-L3, CDR-H1, CDR-H2 and CDR-H3 sequences of H3-7 as set forth in Tables 11J-1 and 11J-2. In some embodiments, ABM1 comprises CDR-L1, CDR-L2, CDR-L3, CDR-H1, CDR-H2 and CDR-H3 sequences of H3-7 as set forth in Tables 11K-1 and 11K-2. In some embodiments, ABM1 comprises CDR-L1, CDR-L2, CDR-L3, CDR-H1, CDR-H2 and CDR-H3 sequences of H3-7 as set forth in Tables 11L-1 and 11L-2. In some embodiments, ABM1 comprises CDR-L1, CDR-L2, CDR-L3, CDR-H1, CDR-H2 and CDR-H3 sequences of H3-7 as set forth in Tables 11M-1 and 11M-2. In some embodiments, ABM1 comprises CDR-L1, CDR-L2, CDR-L3, CDR-H1, CDR-H2 and CDR-H3 sequences of H3-7 as set forth in Tables 11N-1 and 11N-2.

In some embodiments, ABM1 comprises CDR-L1, CDR-L2, CDR-L3, CDR-H1, CDR-H2 and CDR-H3 sequences of H3-8 as set forth in Tables 11I-1 and 11I-2. In some embodiments, ABM1 comprises CDR-L1, CDR-L2, CDR-L3, CDR-H1, CDR-H2 and CDR-H3 sequences of H3-8 as set forth in Tables 11J-1 and 11J-2. In some embodiments, ABM1 comprises CDR-L1, CDR-L2, CDR-L3, CDR-H1, CDR-H2 and CDR-H3 sequences of H3-8 as set forth in Tables 11K-1 and 11K-2. In some embodiments, ABM1 comprises CDR-L1, CDR-L2, CDR-L3, CDR-H1, CDR-H2 and CDR-H3 sequences of H3-8 as set forth in Tables 11L-1 and 11L-2. In some embodiments, ABM1 comprises CDR-L1, CDR-L2, CDR-L3, CDR-H1, CDR-H2 and CDR-H3 sequences of H3-8 as set forth in Tables 11M-1 and 11M-2. In some embodiments, ABM1 comprises CDR-L1, CDR-L2, CDR-L3, CDR-H1, CDR-H2 and CDR-H3 sequences of H3-8 as set forth in Tables 11N-1 and 11N-2.

In some embodiments, ABM1 comprises CDR-L1, CDR-L2, CDR-L3, CDR-H1, CDR-H2 and CDR-H3 sequences of H3-9 as set forth in Tables 11I-1 and 11I-2. In some embodiments, ABM1 comprises CDR-L1, CDR-L2, CDR-L3, CDR-H1, CDR-H2 and CDR-H3 sequences of H3-9 as set forth in Tables 11J-1 and 11J-2. In some embodiments, ABM1 comprises CDR-L1, CDR-L2, CDR-L3, CDR-H1, CDR-H2 and CDR-H3 sequences of H3-9 as set forth in Tables 11K-1 and 11K-2. In some embodiments, ABM1 comprises CDR-L1, CDR-L2, CDR-L3, CDR-H1, CDR-H2 and CDR-H3 sequences of H3-9 as set forth in Tables 11L-1 and 11L-2. In some embodiments, ABM1 comprises CDR-L1, CDR-L2, CDR-L3, CDR-H1, CDR-H2 and CDR-H3 sequences of H3-9 as set forth in Tables 11M-1 and 11M-2. In some embodiments, ABM1 comprises CDR-L1, CDR-L2, CDR-L3, CDR-H1, CDR-H2 and CDR-H3 sequences of H3-9 as set forth in Tables 11N-1 and 11N-2.

In some embodiments, ABM1 comprises CDR-L1, CDR-L2, CDR-L3, CDR-H1, CDR-H2 and CDR-H3 sequences of H3-10 as set forth in Tables 11I-1 and 11I-2. In some embodiments, ABM1 comprises CDR-L1, CDR-L2, CDR-L3, CDR-H1, CDR-H2 and CDR-H3 sequences of H3-10 as set forth in Tables 11J-1 and 11J-2. In some embodiments, ABM1 comprises CDR-L1, CDR-L2, CDR-L3, CDR-H1, CDR-H2 and CDR-H3 sequences of H3-10 as set forth in Tables 11K-1 and 11K-2. In some embodiments, ABM1 comprises CDR-L1, CDR-L2, CDR-L3, CDR-H1, CDR-H2 and CDR-H3 sequences of H3-10 as set forth in Tables 11L-1 and 11L-2. In some embodiments, ABM1 comprises CDR-L1, CDR-L2, CDR-L3, CDR-H1, CDR-H2 and CDR-H3 sequences of H3-10 as set forth in Tables 11M-1 and 11M-2. In some embodiments, ABM1 comprises CDR-L1, CDR-L2, CDR-L3, CDR-H1, CDR-H2 and CDR-H3 sequences of H3-10 as set forth in Tables 11N-1 and 11N-2.

In some embodiments, ABM1 comprises CDR-L1, CDR-L2, CDR-L3, CDR-H1, CDR-H2 and CDR-H3 sequences of H3-11 as set forth in Tables 11I-1 and 11I-2. In some embodiments, ABM1 comprises CDR-L1, CDR-L2, CDR-L3, CDR-H1, CDR-H2 and CDR-H3 sequences of H3-11 as set forth in Tables 11J-1 and 11J-2. In some embodiments, ABM1 comprises CDR-L1, CDR-L2, CDR-L3, CDR-H1, CDR-H2 and CDR-H3 sequences of H3-11 as set forth in Tables 11K-1 and 11K-2. In some embodiments, ABM1 comprises CDR-L1, CDR-L2, CDR-L3, CDR-H1, CDR-H2 and CDR-H3 sequences of H3-11 as set forth in Tables 11L-1 and 11L-2. In some embodiments, ABM1 comprises CDR-L1, CDR-L2, CDR-L3, CDR-H1, CDR-H2 and CDR-H3 sequences of H3-11 as set forth in Tables 11M-1 and 11M-2. In some embodiments, ABM1 comprises CDR-L1, CDR-L2, CDR-L3, CDR-H1, CDR-H2 and CDR-H3 sequences of H3-11 as set forth in Tables 11N-1 and 11N-2.

In some embodiments, ABM1 comprises CDR-L1, CDR-L2, CDR-L3, CDR-H1, CDR-H2 and CDR-H3 sequences of H3-12 as set forth in Tables 11I-1 and 11I-2. In some embodiments, ABM1 comprises CDR-L1, CDR-L2, CDR-L3, CDR-H1, CDR-H2 and CDR-H3 sequences of H3-12 as set forth in Tables 11J-1 and 11J-2. In some embodiments, ABM1 comprises CDR-L1, CDR-L2, CDR-L3, CDR-H1, CDR-H2 and CDR-H3 sequences of H3-12 as set forth in Tables 11K-1 and 11K-2. In some embodiments, ABM1 comprises CDR-L1, CDR-L2, CDR-L3, CDR-H1, CDR-H2 and CDR-H3 sequences of H3-12 as set forth in Tables 11L-1 and 11L-2. In some embodiments, ABM1 comprises CDR-L1, CDR-L2, CDR-L3, CDR-H1, CDR-H2 and CDR-H3 sequences of H3-12 as set forth in Tables 11M-1 and 11M-2. In some embodiments, ABM1 comprises CDR-L1, CDR-L2, CDR-L3, CDR-H1, CDR-H2 and CDR-H3 sequences of H3-12 as set forth in Tables 11N-1 and 11N-2.

In some embodiments, ABM1 comprises CDR-L1, CDR-L2, CDR-L3, CDR-H1, CDR-H2 and CDR-H3 sequences of H3-13 as set forth in Tables 11I-1 and 11I-2. In some embodiments, ABM1 comprises CDR-L1, CDR-L2, CDR-L3, CDR-H1, CDR-H2 and CDR-H3 sequences of H3-13 as set forth in Tables 11J-1 and 11J-2. In some embodiments, ABM1 comprises CDR-L1, CDR-L2, CDR-L3, CDR-H1, CDR-H2 and CDR-H3 sequences of H3-13 as set forth in Tables 11K-1 and 11K-2. In some embodiments, ABM1 comprises CDR-L1, CDR-L2, CDR-L3, CDR-H1, CDR-H2 and CDR-H3 sequences of H3-13 as set forth in Tables 11L-1 and 11L-2. In some embodiments, ABM1 comprises CDR-L1, CDR-L2, CDR-L3, CDR-H1, CDR-H2 and CDR-H3 sequences of H3-13 as set forth in Tables 11M-1 and 11M-2. In some embodiments, ABM1 comprises CDR-L1, CDR-L2, CDR-L3, CDR-H1, CDR-H2 and CDR-H3 sequences of H3-13 as set forth in Tables 11N-1 and 11N-2.

In some embodiments, ABM1 comprises CDR-L1, CDR-L2, CDR-L3, CDR-H1, CDR-H2 and CDR-H3 sequences of H3-14 as set forth in Tables 11I-1 and 11I-2. In some embodiments, ABM1 comprises CDR-L1, CDR-L2, CDR-L3, CDR-H1, CDR-H2 and CDR-H3 sequences of H3-14 as set forth in Tables 11J-1 and 11J-2. In some embodiments, ABM1 comprises CDR-L1, CDR-L2, CDR-L3, CDR-H1, CDR-H2 and CDR-H3 sequences of H3-14 as set forth in Tables 11K-1 and 11K-2. In some embodiments, ABM1 comprises CDR-L1, CDR-L2, CDR-L3, CDR-H1, CDR-H2 and CDR-H3 sequences of H3-14 as set forth in Tables 11L-1 and 11L-2. In some embodiments, ABM1 comprises CDR-L1, CDR-L2, CDR-L3, CDR-H1, CDR-H2 and CDR-H3 sequences of H3-14 as set forth in Tables 11M-1 and 11M-2. In some embodiments, ABM1 comprises CDR-L1, CDR-L2, CDR-L3, CDR-H1, CDR-H2 and CDR-H3 sequences of H3-14 as set forth in Tables 11N-1 and 11N-2.

In some embodiments, ABM1 comprises CDR-L1, CDR-L2, CDR-L3, CDR-H1, CDR-H2 and CDR-H3 sequences of H3-15 as set forth in Tables 11I-1 and 11I-2. In some embodiments, ABM1 comprises CDR-L1, CDR-L2, CDR-L3, CDR-H1, CDR-H2 and CDR-H3 sequences of H3-15 as set forth in Tables 11J-1 and 11J-2. In some embodiments, ABM1 comprises CDR-L1, CDR-L2, CDR-L3, CDR-H1, CDR-H2 and CDR-H3 sequences of H3-15 as set forth in Tables 11K-1 and 11K-2. In some embodiments, ABM1 comprises CDR-L1, CDR-L2, CDR-L3, CDR-H1, CDR-H2 and CDR-H3 sequences of H3-15 as set forth in Tables 11L-1 and 11L-2. In some embodiments, ABM1 comprises CDR-L1, CDR-L2, CDR-L3, CDR-H1, CDR-H2 and CDR-H3 sequences of H3-15 as set forth in Tables 11M-1 and 11M-2. In some embodiments, ABM1 comprises CDR-L1, CDR-L2, CDR-L3, CDR-H1, CDR-H2 and CDR-H3 sequences of H3-15 as set forth in Tables 11N-1 and 11N-2.

In some embodiments, ABM1 comprises a light chain variable sequence and/or heavy chain variable sequence of AB1 as set forth in Table 11O-1 and Table 11O-2. In some embodiments, ABM1 comprises a light chain variable sequence and/or heavy chain variable sequence of AB2 as set forth in Table 11O-1 and Table 11O-2. In some embodiments, ABM1 comprises a light chain variable sequence and/or heavy chain variable sequence of R1F2 as set forth in Table 11O-1 and Table 11O-2. In some embodiments, ABM1 comprises a light chain variable sequence and/or heavy chain variable sequence of PALF03 as set forth in Table 11O-1 and Table 11O-2. In some embodiments, ABM1 comprises a light chain variable sequence and/or heavy chain variable sequence of PALF04 as set forth in Table 11O-1 and Table 11O-2. In some embodiments, ABM1 comprises a light chain variable sequence and/or heavy chain variable sequence of PALF05 as set forth in Table 11O-1 and Table 11O-2. In some embodiments, ABM1 comprises a light chain variable sequence and/or heavy chain variable sequence of PALF06 as set forth in Table 11O-1 and Table 11O-2. In some embodiments, ABM1 comprises a light chain variable sequence and/or heavy chain variable sequence of PALF07 as set forth in Table 11O-1 and Table 11O-2. In some embodiments, ABM1 comprises a light chain variable sequence and/or heavy chain variable sequence of PALF08 as set forth in Table 11O-1 and Table 11O-2. In some embodiments, ABM1 comprises a light chain variable sequence and/or heavy chain variable sequence of PALF09 as set forth in Table 11O-1 and Table 11O-2. In some embodiments, ABM1 comprises a light chain variable sequence and/or heavy chain variable sequence of PALF12 as set forth in Table 11O-1 and Table 11O-2. In some embodiments, ABM1 comprises a light chain variable sequence and/or heavy chain variable sequence of PALF13 as set forth in Table 11O-1 and Table 11O-2. In some embodiments, ABM1 comprises a light chain variable sequence and/or heavy chain variable sequence of PALF14 as set forth in Table 11O-1 and Table 11O-2. In some embodiments, ABM1 comprises a light chain variable sequence and/or heavy chain variable sequence of PALF15 as set forth in Table 11O-1 and Table 11O-2. In some embodiments, ABM1 comprises a light chain variable sequence and/or heavy chain variable sequence of PALF16 as set forth in Table 11O-1 and Table 11O-2. In some embodiments, ABM1 comprises a light chain variable sequence and/or heavy chain variable sequence of PALF17 as set forth in Table 11O-1 and Table 11O-2. In some embodiments, ABM1 comprises a light chain variable sequence and/or heavy chain variable sequence of PALF18 as set forth in Table 11O-1 and Table 11O-2. In some embodiments, ABM1 comprises a light chain variable sequence and/or heavy chain variable sequence of PALF19 as set forth in Table 11O-1 and Table 11O-2. In some embodiments, ABM1 comprises a light chain variable sequence and/or heavy chain variable sequence of PALF20 as set forth in Table 11O-1 and Table 11O-2. In some embodiments, ABM1 comprises a light chain variable sequence and/or heavy chain variable sequence of AB3 as set forth in Table 11O-1 and Table 11O-2. In some embodiments, ABM1 comprises a light chain variable sequence and/or heavy chain variable sequence of PI-61 as set forth in Table 11O-1 and Table 11O-2. In some embodiments, ABM1 comprises a light chain variable sequence and/or heavy chain variable sequence of H3-1 as set forth in Table 11O-1 and Table 11O-2. In some embodiments, ABM1 comprises a light chain variable sequence and/or heavy chain variable sequence of H3-2 as set forth in Table 11O-1 and Table 11O-2. In some embodiments, ABM1 comprises a light chain variable sequence and/or heavy chain variable sequence of H3-3 as set forth in Table 11O-1 and Table 11O-2. In some embodiments, ABM1 comprises a light chain variable sequence and/or heavy chain variable sequence of H3-4 as set forth in Table 11O-1 and Table 11O-2. In some embodiments, ABM1 comprises a light chain variable sequence and/or heavy chain variable sequence of H3-5 as set forth in Table 11O-1 and Table 11O-2. In some embodiments, ABM1 comprises a light chain variable sequence and/or heavy chain variable sequence of H3-6 as set forth in Table 11O-1 and Table 11O-2. In some embodiments, ABM1 comprises a light chain variable sequence and/or heavy chain variable sequence of H3-7 as set forth in Table 11O-1 and Table 11O-2. In some embodiments, ABM1 comprises a light chain variable sequence and/or heavy chain variable sequence of H3-8 as set forth in Table 11O-1 and Table 11O-2. In some embodiments, ABM1 comprises a light chain variable sequence and/or heavy chain variable sequence of H3-9 as set forth in Table 11O-1 and Table 11O-2. In some embodiments, ABM1 comprises a light chain variable sequence and/or heavy chain variable sequence of H3-10 as set forth in Table 11O-1 and Table 11O-2. In some embodiments, ABM1 comprises a light chain variable sequence and/or heavy chain variable sequence of H3-11 as set forth in Table 11O-1 and Table 11O-2. In some embodiments, ABM1 comprises a light chain variable sequence and/or heavy chain variable sequence of H3-12 as set forth in Table 11O-1 and Table 11O-2. In some embodiments, ABM1 comprises a light chain variable sequence and/or heavy chain variable sequence of H3-13 as set forth in Table 11O-1 and Table 11O-2. In some embodiments, ABM1 comprises a light chain variable sequence and/or heavy chain variable sequence of H3-14 as set forth in Table 11O-1 and Table 11O-2. In some embodiments, ABM1 comprises a light chain variable sequence and/or heavy chain variable sequence of H3-15 as set forth in Table 11O-1 and Table 11O-2.

In some embodiments, ABM1 comprises a scFv sequence of H2/L2-88 as set forth in Table 11P. In some embodiments, ABM1 comprises a scFv sequence of H2/L2-36 as set forth in Table 11P. In some embodiments, ABM1 comprises a scFv sequence of H2/L2-34 as set forth in Table 11P. In some embodiments, ABM1 comprises a scFv sequence of H2/L2-68 as set forth in Table 11P. In some embodiments, ABM1 comprises a scFv sequence of H2/L2-18 as set forth in Table 11P. In some embodiments, ABM1 comprises a scFv sequence of H2/L2-47 as set forth in Table 11P. In some embodiments, ABM1 comprises a scFv sequence of H2/L2-20 as set forth in Table 11P. In some embodiments, ABM1 comprises a scFv sequence of H2/L2-80 as set forth in Table 11P. In some embodiments, ABM1 comprises a scFv sequence of H2/L2-83 as set forth in Table 11P.

Given that ABM1 binds BCMA, and that antigen binding specificity is provided primarily by the CDR-H1, CDR-H2, CDR-H3, CDR-L1, CDR-L2, and CDR-L3 regions, the CDR-H1, CDR-H2, CDR-H3, CDR-L1, CDR-L2, and CDR-L3 sequences can be "mixed and matched". Such "mixed and matched" BCMA binding ABMs can be tested using known binding assays (e.g., ELISAs). When VH CDR sequences are mixed and matched, the CDR-H1, CDR-H2 and/or CDR-H3 sequence from a particular VH sequence should be replaced with a structurally similar CDR sequence(s). Likewise, when VL CDR sequences are mixed and matched, the CDR-L1, CDR-L2 and/or CDR-L3 sequence from a particular VL sequence should be replaced with a structurally similar CDR sequence(s). It will be readily apparent to the ordinarily skilled artisan that novel VH and VL sequences can be created by substituting one or more VH and/or VL CDR region sequences with structurally similar sequences from CDR sequences shown herein.

In some embodiments, ABM1 comprises a VL sequence selected from the VL sequences set forth in Table 11O-1 and a VH sequence selected the VH sequences set forth in Table 11O-2. In some embodiments, ABM1 comprises a CDR-H1 sequence selected from the CDR-H1 sequences set forth in Table 11A-2, Table 11B-2, Table 11C-2, Table 11D-2, Table 11E-2, Table 11F-2, Table 11G-2, Table 11H-2, Table 11I-2, Table 11J-2, Table 11K-2, Table 11L-2, Table 11M-2, and Table 11N-2; a CDR-H2 sequence selected from the CDR-H2 sequences set forth in Table 11A-2, Table 11B-2, Table 11C-2, Table 11D-2, Table 11E-2, Table 11F-2, Table 11G-2, Table 11H-2, Table 11I-2, Table 11J-2, Table 11K-2, Table 11L-2, Table 11M-2, and Table 11N-2; a CDR-H3 sequence selected from the CDR-H3 sequences set forth in Table 11A-2, Table 11B-2, Table 11C-2, Table 11D-2, Table 11E-2, Table 11F-2, Table 11G-2, Table 11H-2, Table 11I-2, Table 11J-2, Table 11K-2, Table 11L-2, Table 11M-2, and Table 11N-2; a CDR-L1 sequence selected from the CDR-L1 sequences set forth in Table 11A-1, Table 11B-1, Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a), and Table 11N-1(b); a CDR-L2 sequence selected from the CDR-L2 sequences set forth in Table 11A-1, Table 11B-1, Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a), and Table 11N-1(b); and a CDR-L3 sequence selected from the CDR-L3 sequences set forth in Table 11A-1, Table 11B-1, Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a), and Table 11N-1(b).

Additional BCMA ABMs can be generated through the techniques of gene-shuffling, motif-shuffling, exon-shuffling, and/or codon-shuffling (collectively referred to as "DNA shuffling"). DNA shuffling can be employed to alter the activities of molecules of the disclosure or fragments thereof (e.g., molecules or fragments thereof with higher affinities and lower dissociation rates). See, generally, U.S. Pat. Nos. 5,605,793, 5,811,238, 5,830,721, 5,834,252, and 5,837,458; Patten et al., (1997) Curr. Opinion Biotechnol. 8:724-33; Harayama, (1998) Trends Biotechnol. 16(2):76-82; Hansson et al., (1999) J. Mol. Biol. 287:265-76; and Lorenzo and Blasco, (1998) Biotechniques 24(2):308-313. The BCMA ABMs described herein can be altered by being subjected to random mutagenesis by error-prone PCR, random nucleotide insertion or other methods prior to recombination.

7.6. TCR ABMs

The MBMs (e.g., TBMs) contain an ABM that specifically binds to a component of a TCR complex. The TCR is a disulfide-linked membrane-anchored heterodimeric protein normally consisting of the highly variable alpha (α) and beta (β) chains expressed as part of a complex with the invariant CD3 chain molecules. T cells expressing this receptor are referred to as α:β (or αβ) T cells, though a minority of T cells express an alternate receptor, formed by variable gamma (γ) and delta (δ) chains, referred as γδ T cells.

In an embodiment, MBMs contain an ABM that specifically binds to CD3.

7.6.1. CD3 ABMs

The MBMs (e.g., TBMs) can contain an ABM that specifically binds to CD3. The term "CD3" refers to the cluster of differentiation 3 co-receptor (or co-receptor complex, or polypeptide chain of the co-receptor complex) of the T cell receptor. The amino acid sequence of the polypeptide chains of human CD3 are provided in NCBI Accession P04234, P07766 and P09693. CD3 proteins can also include variants. CD3 proteins can also include fragments. CD3 proteins also include post-translational modifications of the CD3 amino acid sequences. Post-translational modifications include, but are not limited to, N- and O-linked glycosylation.

In some embodiments, a MBM (e.g., TBM) can comprise an ABM which is an anti-CD3 antibody (e.g., as described in US 2016/0355600, WO 2014/110601, and WO 2014/145806) or an antigen-binding domain thereof. Exemplary anti-CD3 VH, VL, and scFV sequences that can be used in MBMs (e.g., TBMs) are provided in Table 12A.

TABLE 12A

| Binding Domain | Chain | Sequence | SEQ ID NO: |
|---|---|---|---|
| | | CD3 Binders - Variable domain sequences | |
| CD3-1 | VH | QVQLQQSGAELARPGASVKMSCKASGYTFTRYTMHWVKQRPGQG LEWIGYINPSRGYTNYNQKFKDKATLTTDKSSSTAYMQLSSLTSEDS AVYYCARYYDDHYCLDYWGQGTTLTVSS | 329 |
| | VL | QIVLTQSPAIMSASPGEKVTMTCSASSSVSYMNWYQQKSGTSPKR WIYDTSKLASGVPAHFRGSGSGTSYSLTISGMEAEDAATYYCQQW SSNPFTFGSGTKLEIN | 330 |
| CD3-2 | VH | EVQLVESGGGLVQPKGSLKLSCAASGFTFNTYAMNWVRQAPGKGL EWVARIRSKYNNYATYYADSVKDRFTISRDDSQSILYLQMNNLKTED TAMYYCVRHGNFGNSYVSWFAYWGQGTLVTVSA | 331 |
| | VL | QAVVTQESALTTSPGETVTLTCRSSTGAVTTSNYANWVQEKPDHLF TGLIGGTNKRAPGVPARFSGSLIGDKAALTITGAQTEDEAIYFCALWY SNLWVFGGGTKLTVL | 332 |
| CD3-3 | VH | QVQLQQSGAELARPGASVKMSCKASGYTFTSYTMHWVKQRPGQG LEWIGYINPSSGYTKYNQKFKDKATLTADKSSSTAYMQLSSLTSEDS AVYYCARWQDYDVYFDYWGQGTTLTVSS | 333 |

TABLE 12A-continued

CD3 Binders - Variable domain sequences

| Binding Domain | Chain | Sequence | SEQ ID NO: |
|---|---|---|---|
| | VL | QIVLSQSPAILSASPGEKVTMTCRASSSVSYMHWYQQKPGSSPKP WIYATSNLASGVPARFSGSGSGTSYSLTISRVEAEDAATYYCQQWS SNPPTFGGGTKLETK | 334 |
| CD3-4 | VH | QVQLQQSGAELARPGASVKMSCKASGYTFTRYTMHWVKQRPGQG LEWIGYINPSRGYTNYNQKFKDKATLTTDKSSSTAYMQLSSLTSEDS AVYYCARYYDDHYCLDYWGQGTTLTVSS | 329 |
| | VL | QIVLTQSPAIMSASPGEKVTMTCRASSSVSYMNWYQQKSGTSPKR WIYDTSKVASGVPYRFSGSGSGTSYSLTISSMEAEDAATYYCQQWS SNPLTFGSGTKLEIN | 335 |
| CD3-5 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYCLDYWGQGTPVTVSS | 336 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWS SNPFTFGQGTKLQIT | 337 |
| CD3-6 | VH | QVQLVESGGGVVQPGRSLRLSCAASGFKFSGYGMHWVRQAPGKG LEWVAVIWYDGSKKYYVDSVKGRFTISRDNSKNTLYLQMNSLRAED TAVYYCARQMGYWHFDLWGRGTLVTVSS | 338 |
| | VL | EIVLTQSPATLSLSPGERATLSCRASQSVSSYLAWYQQKPGQAPRL LIYDASNRATGIPARFSGSGSGTDFTLTISSLEPEDFAVYYCQQRSN WPPLTFGGGTKVEIK | 339 |
| CD3-7 | VH | EVQLVESGGGLVQPGGSLRLSCAASGFTFSTYAMNWVRQAPGKGL EWVGRIRSKYNNYATYYADSVKDRFISRDDSKNSLYLQMNSLKTED TAVYYCVRHGNFGNSYVSWFAYWGQGTLVTVSS | 340 |
| | VL | QAVVTQEPSLTVSPGGTVTLTCRSSTGAVTTSNYANWVQQKPGQA PRGLIGGTNKRAPWTPARFSGSLLGGKAALIGAQAEDEADYYCALW YSNLWVFGGGTKLTVL | 341 |
| CD3-8 | VH | DIKLQQSGAELARPGASVKMSCKTSGYTFTRYTMHWVKQRPGQGL EWIGYINPSRGYTNYNQKFKDKATLTTDKSSSTAYMQLSSLTSEDSA VYYCARYYDDHYCLDYWGQGTTLTVSS | 342 |
| | VL | DIQLTQSPAIMSASPGEKVTMTCRASSSVSYMNWYQQKSGTSPKR WIYDTSKVASGVPYRFSGSGSGTSYSLISSMEAEDAATYYCQQWS SNPLTFGAGTKLELK | 343 |
| CD3-9 | VH | EVQLVESGGGLVQPGGSLRLSCAASGFTFNTYAMNWVRQAPGKG LEWVARIRSKYNNYATYYADSVKDRFISRDDSKNSLYLQMNSLKTE DTAVYYCVRHGNFGNSYVSWFAYWGQGTLVTVSS | 344 |
| | VL | QAVVTQEPSLTVSPGGTVTLTCRSSTGAVTTSNYANWVQQKPGQA PRGLIGGTNKRAPWTPARFSGSLLGGKAALIGAQAEDEADYYCALW YSNLWVFGGGTKLTVL | 341 |
| CD3-10 | VH | EVKLLESGGGLVQPGKSLKLSCAASGFTFNTYAMNWVRQAPGKGL EWVARIRSKYNNYATYYADSVKDRFTISRDDSQSILYLQMNNLKTED TAMYYCVRHGNFGNSYVSWFAYWGQGTLVTVSA | 345 |
| | VL | QAVVTQESALTTSPGETVTLTCRSSTGAVTTSNYANWVQEKPDHLF TGLIGGTNKRAPGVPARFSGSLIGDKAALTITGAQTEDEAIYFCALWY SNLWVFGGGTKLTVL | 332 |
| CD3-11 | VH | EVQLVESGGGLVQPGGSLKLSCAASGFTFNSYAMNWVRQAPGKG LEWVARIRSKYNNYATYYADSVKGRFTISRDDSKNTAYLQMNNLKT EDTAVYYCVRHGNFGNSYVSWWAYWGQGTLVTVSS | 346 |
| | VL | QTVVTQEPSLTVSPGGTVTLTCGSSTGAVTSGNYPNWVQQKPGQA PRGLIGGTKFLAPGTPQRFSGSLLGGKAALTLSGVQPEDEAEYYCV LWYSNRWVFGGGTKLTVL | 347 |
| CD3-12 | VH | EVQLVESGGGLVQPGGSLKLSCAASGFTFNKYAMNWVRQAPGKG LEWVARIRSKYNNYATYYADSVKDRFTISRDDSKNTAYLQMNNLKT EDTAVYYCVRHGNFGNSYISYWAYWGQGTLVTVSS | 348 |
| | VL | QTVVTQEPSLTVSPGGTVTLTCGSSTGAVTSGNYPNWVQQKPGQA PRGLIGGTKFLAPGTPARFSGSLLGGKAALTLSGVQPEDEAEYYCVL WYSNRWVFGGGTKLTVL | 349 |
| | scFv | EVQLVESGGGLVQPGGSLKLSCAASGFTFNKYAMNWVRQAPGKG LEWVARIRSKYNNYATYYADSVKDRFTISRDDSKNTAYLQMNNLKT EDTAVYYCVRHGNFGNSYISYWAYWGQGTLVTVSSGGGGSGGGG SGGGGSGGGGSQTVVTQEPSLTVSPGGTVTLTCGSSTGAVTSGNY PNWVQQKPGQAPRGLIGGTKFLAPGTPARFSGSLLGGKAALTLSGV QPEDEAEYYCVLWYSNRWVFGGGTKLTVL | 350 |

TABLE 12A-continued

CD3 Binders - Variable domain sequences

| Binding Domain | Chain | Sequence | SEQ ID NO: |
|---|---|---|---|
| CD3-13 | VH | QVQLVQSGAEVKKPGASVKVSCKASGYTFTRYTMHWVRQAPGQG LEWMGYINPSRGYTNYNQKFKDRVTMTTDTSISTAYMELSRLRSDD TAVYYCARYYDDHYCLDYWGQGTLVTVSS | 351 |
| | VL | EIVLTQSPATLSLSPGERATLSCSASSSVSYMNWYQQKPGQAPRLLI YDTSKLASGVPAHFRGSGSGTDFTLTISSLEPEDFAVYYCQQWSSN PFTFGQGTKVEIK | 352 |
| CD3-14 | VH | EVQLVESGGGLVQPGGSLRLSCAASGFTFSTYAMNWVRQAPGKGL EWVSRIRSKYNNYATYYADSVKDRFTISRDDSKNTLYLQMNSLRAE DTAVYYCARHGNFGNSYVSWFAYWGQGTMVTVSS | 353 |
| | VL | QAVVTQEPSLTVSPGGTVTLTCRSSTGAVTTSNYANWVQQKPGQA PRGLIGGTNKRAPGTPARFSGSLLGGKAALTLSGVQPEDEAEYYCA LWYSNLWVFGGGTKLTVL | 354 |
| CD3-15 | VH | EVQLVESGGGLVQPGGSLRLSCAASGFTFNTYAMNWVRQAPGKG LEWVGRIRSKYNNYATYYADSVKDRFTISRDDSKNSLYLQMNSLKT EDTAVYYCVRHGNFGNSYVSWFAYWGQGTLVTVSS | 355 |
| | VL | QAVVTQEPSLTVSPGGTVTLTCRSSTGAVTTSNYANWVQEKPGQA PRGLIGGTNKRAPWTPARFSGSLLGGKAALTITGAQAEDEADYYCA LWYSNLWVFGGGTKLTVL | 356 |
| CD3-16 | VH | EVQLVESGGGLVQPGGSLRLSCAASGFTFNTYAMNWVRQAPGKG LEWVGRIRSKYNNYATYYADSVKGRFTISRDDSKNTLYLQMNSLRA EDTAVYYCVRHGNFGNSYVSWFAYWGQGTLVTVSS | 357 |
| | VL | QAVVTQEPSLTVSPGGTVTLTCGSSTGAVTTSNYANWVQQKPGQA PRGLIGGTNKRAPGVPARFSGSLLGGKAALTLSGAQPEDEAEYYCA LWYSNLWVFGGGTKLTVL | 358 |
| CD3-17 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSS | 359 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| CD3-18 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYCLDYWGQGTPVTVSS | 336 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWS SNPFTFGQGT | 361 |
| CD3-19 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYSLDYWGQGTPVTVSS | 362 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWS SNPFTFGQGT | 361 |
| CD3-20 | VH | EVQLQQSGPELVKPGASMKISCKASGYSFTGYTMNWVKQSHGKNL EWMGLINPYKGVSTYNQKFKDKATLTVDKSSSTAYMELLSLTSEDS AVYYCARSGYYGDSDWYFDVWGQGTTLTVFS | 363 |
| | VL | DIQMTQTTSSLSASLGDRVTISCRASQDIRNYLNWYQQKPDGTVKLL IYYTSRLHSGVPSKFSGSGSGTDYSLTISNLEQEDIATYFCQQGNTL PWTFAGGTKLEIK | 364 |
| CD3-21 | VH | EVQLVESGGGLVQPGGSLKLSCAASGFTFNTYAMNWVRQASGKGL EWVGRIRSKYNNYATYYADSVKDRFTISRDDSKSTLYLQMNSLKTE DTAVYYCVRHGNFGNSYVSWFAYWGQGTLVTVSS | 365 |
| | VL | QAVVTQEPSLTVSPGGTVTLTCRSSTGAVTTSNYANWVQQKPGQA PRGLIGGTNKRAPWTPARFSGSLLGDKAALTLSGAQPEDEAEYFCA LWYSNLWVFGGGTKLTVL | 366 |
| | scFv | EVQLVESGGGLVQPGGSLKLSCAASGFTFNTYAMNWVRQASGKGL EWVGRIRSKYNNYATYYADSVKDRFTISRDDSKSTLYLQMNSLKTE DTAVYYCVRHGNFGNSYVSWFAYWGQGTLVTVSSGGGGSGGGG SGGGGSGGGGSQAVVTQEPSLTVSPGGTVTLTCRSSTGAVTTSNY ANWVQQKPGQAPRGLIGGTNKRAPWTPARFSGSLLGDKAALTLSG AQPEDEAEYFCALWYSNLWVFGGGTKLTVL | 367 |
| CD3-22 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSS | 359 |

TABLE 12A-continued

CD3 Binders - Variable domain sequences

| Binding Domain | Chain | Sequence | SEQ ID NO: |
|---|---|---|---|
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 368 |
| CD3-23 | VH | EVQLVESGGGLVQPGGSLRLSCAASGFTFSTYAMNWVRQAPGKGL EWVGRIRSKANNYATYYADSVKGRFTISRDDSKNTLYLQMNSLRAE DTAVYYCVRHGNFGDSYVSWFAYWGQGTLVTVSS | 369 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMNWVRQAPGKGL EWVGRIRSKANNYATYYADSVKGRFTISRDDSKNTLYLQMNSLRAE DTAVYYCVRHGNFGDSYVSWFAYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 370 |
| CD3-24 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDEYVSWFAYWGQGTLVTVSS | 371 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDEYVSWFAYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 372 |
| CD3-25 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDPYVSWFAYWGQGTLVTVSS | 373 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDPYVSWFAYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 374 |
| CD3-26 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFDYWGQGTLVTVSS | 375 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFDYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 376 |
| CD3-27 | VH | EVQLVESGGGLVQPGGSLRLSCAASGFTFSTYAMSWVRQAPGKGL EWVGRIRSKYNNYATYYADSVKGRFTISRDDSKNTLYLQMNSLRAE DTAVYYCVRHGNFGDSYVSWFAYWGQGTLVTVSS | 377 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCA LWYSNHWVFGGGTKLTVL | 360 |
| | scFv | EVQLVESGGGLVQPGGSLRLSCAASGFTFSTYAMSWVRQAPGKGL EWVGRIRSKYNNYATYYADSVKGRFTISRDDSKNTLYLQMNSLRAE DTAVYYCVRHGNFGDSYVSWFAYWGQGTLVTVSSGKPGSGKPGS GKPGSGKPGSQAVVTQEPSLTVSPGGTVTLTCGSSTGAVTTSNYA NWVQQKPGKSPRGLIGGTNKRAPGVPARFSGSLLGGKAALTISGA QPEDEADYYCALWYSNHWVFGGGTKLTVL | 378 |

TABLE 12A-continued

| CD3 Binders - Variable domain sequences | | | |
|---|---|---|---|
| Binding Domain | Chain | Sequence | SEQ ID NO: |
| CD3-28 | VH | EVQLVESGGGLVQPGGSLRLSCAASGFTFNTYAMNWVRQAPGKG LEWVGRIRSKYNNYATYYADSVKGRFTISRDDSKNTLYLQMNSLRA EDTAVYYCVRHGNFGNSYVSWFAYWGQGTLVTVSS | 357 |
| | VL | QAVVTQEPSLTVSPGGTVTLTCGSSTGAVTTSNYANWVQQKPGQA PRGLIGGTNKRAPGVPARFSGSLLGGKAALTLSGAQPEDEAEYYCA LWYSNLWVFGGGTKLTVL | 358 |
| | scFv | EVQLVESGGGLVQPGGSLRLSCAASGFTFNTYAMNWVRQAPGKG LEWVGRIRSKYNNYATYYADSVKGRFTISRDDSKNTLYLQMNSLRA EDTAVYYCVRHGNFGNSYVSWFAYWGQGTLVTVSSGGGGSGGG GSGGGGSQAVVTQEPSLTVSPGGTVTLTCGSSTGAVTTSNYANWV QQKPGQAPRGLIGGTNKRAPGVPARFSGSLLGGKAALTLSGAQPE DEAEYYCALWYSNLWVFGGGTKLTVLGSHHHHHH | 379 |
| CD3-129 | VH | EVQLVESGGGLVQPGGSLKLSCAASGFTFNTYAMNWVRQASGKGL EWVGRIRSKYNNYATYYADSVKDRFTISRDDSKNTAYLQMNSLKTE DTAVYYCVRHGNFGNSYVSWFAHWGQGTLVTVSS | 380 |
| | VL | QAVVTQEPSLTVSPGGTVTLTCGSSTGAVTSSNYANWVQQKPGQA PRGLIGGTNKRAPWTPARFSGSLLGGKAALTLSGAQPEDEAEYYCA LWYSNLWVFGGGTKLTVL | 381 |
| | scFv | EVQLVESGGGLVQPGGSLKLSCAASGFTFNTYAMNWVRQASGKGL EWVGRIRSKYNNYATYYADSVKDRFTISRDDSKNTAYLQMNSLKTE DTAVYYCVRHGNFGNSYVSWFAHWGQGTLVTVSSGGGGSGGGG SGGGGSGGGGSQAVVTQEPSLTVSPGGTVTLTCGSSTGAVTSSNY ANWVQQKPGQAPRGLIGGTNKRAPWTPARFSGSLLGGKAALTLSG AQPEDEAEYYCALWYSNLWVFGGGTKLTVL | 382 |
| CD3-130 | VH | EVQLVESGGGLVQPGGSLKLSCAASGFTFNTYAMNWVRQASGKGL EWVGRIRSKYNNYATYYADSVKDRFTISRDDSKSTAYLQMNSLKTE DTAVYYCVRHGNFGNSYVSWFAYWGQGTLVTVSS | 383 |
| | VL | QAVVTQEPSLTVSPGGTVTLTCRSSTGAVTTSNYANWVQQKPGQA PRGLIGGTNKRAPWTPARFSGSLLGDKAALTLSGAQPEDEAEYFCA LWYSNLWVFGGGTKLTVL | 366 |
| | scFv | EVQLVESGGGLVQPGGSLKLSCAASGFTFNTYAMNWVRQASGKGL EWVGRIRSKYNNYATYYADSVKDRFTISRDDSKSTAYLQMNSLKTE DTAVYYCVRHGNFGNSYVSWFAYWGQGTLVTVSSGGGGSGGGG SGGGGSQAVVTQEPSLTVSPGGTVTLTCRSSTGAVTTSNY ANWVQQKPGQAPRGLIGGTNKRAPWTPARFSGSLLGDKAALTLSG AQPEDEAEYFCALWYSNLWVFGGGTKLTVL | 384 |

CDR sequences for a number of CD3 binders as defined by the Kabat numbering scheme (Kabat et al, 1991, Sequences of Proteins of Immunological Interest, 5<sup>th</sup> Ed. Public Health Service, National Institutes of Health, Bethesda, Md.), Chothia numbering scheme (Al-Lazikani et al., 1997, J. Mol. Biol 273:927-948), and a combination of Kabat and Chothia numbering are provided in Tables 12B-12D, respectively.

TABLE 12B

| CD3 Binders - CDR sequences according to Kabat numbering scheme | | | | | | | |
|---|---|---|---|---|---|---|---|
| Binding Domain | Chain | CDR1 | SEQ ID NO: | CDR2 | SEQ ID NO: | CDR3 | SEQ ID NO: |
| CD3-1 | VH | RYTMH | 385 | YINPSRGYTNYNQK FKD | 405 | YYDDHYCLDY | 429 |
| | VL | SASSSVSYM N | 386 | DTSKLAS | 406 | QQWSSNPFT | 430 |
| CD3-2 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |
| CD3-3 | VH | SYTMH | 389 | YINPSSGYTKYNQK FKD | 409 | WQDYDVYFDY | 433 |
| | VL | RASSSVSYM H | 390 | ATSNLAS | 410 | QQWSSNPPT | 434 |
| CD3-4 | VH | RYTMH | 385 | YINPSRGYTNYNQK FKD | 405 | YYDDHYCLDY | 429 |
| | VL | RASSSVSYM N | 391 | DTSKVAS | 411 | QQWSSNPLT | 435 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-5 | VH | RYTMH | 385 | YINPSRGYTNYNQK VKD | 412 | YYDDHYCLDY | 429 |
| | VL | SASSSVSYM N | 386 | DTSKLAS | 406 | QQWSSNPFT | 430 |
| CD3-6 | VH | GYGMH | 392 | VIWYDGSKKYYVDS VKG | 413 | QMGYWHFDL | 436 |
| | VL | RASQSVSSY LA | 393 | DASNRAT | 414 | QQRSNWPPLT | 437 |
| CD3-7 | VH | TYAMN | 387 | RIRSKYNNYATYYA D | 415 | VRHGNFGNSYV SWFAY | 438 |
| | VL | RSSTGAVTT SNYAN | 388 | GTNKRAP | 408 | ALWYSNLWV | 432 |
| CD3-8 | VH | RYTMH | 385 | YINPSRGYTNYNQK FKD | 405 | YYDDHYCLDY | 429 |
| | VL | RASSSVSYM N | 391 | DTSKVAS | 411 | QQWSSNPLT | 435 |
| CD3-9 | VH | TYAMN | 387 | RIRSKYNNYATYYA D | 415 | VRHGNFGNSYV SWFAY | 438 |
| | VL | RSSTGAVTT SNYAN | 388 | GTNKRAP | 408 | ALWYSNLWV | 432 |
| CD3-10 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |
| CD3-11 | VH | SYAMN | 394 | RIRSKYNNYATYYA DSVKG | 416 | HGNFGNSYVS WWAY | 439 |
| | VL | GSSTGAVTS GNYPN | 395 | GTKFLAP | 417 | VLWYSNRWV | 440 |
| CD3-12 | VH | KYAMN | 396 | RIRSKYNNYATYYA DSVKD | 407 | HGNFGNSYISY WAY | 441 |
| | VL | GSSTGAVTS GNYPN | 395 | GTKFLAP | 417 | VLWYSNRWV | 440 |
| CD3-13 | VH | RYTMH | 385 | YINPSRGYTNYNQK FKD | 405 | YYDDHYCLDY | 429 |
| | VL | SASSSVSYM N | 386 | DTSKLAS | 406 | QQWSSNPFT | 430 |
| CD3-14 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |
| CD3-15 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |
| CD3-16 | VH | TYAMN | 387 | RIRSKYNNYATYYA DSVKG | 416 | HGNFGNSYVS WFAY | 431 |
| | VL | GSSTGAVTT SNYAN | 397 | GTNKRAP | 408 | ALWYSNLWV | 432 |
| CD3-17 | VH | TYAMN | 387 | RIRSKYNNYATYYA DSVKG | 416 | HGNFGDSYVS WFAY | 442 |
| | VL | GSSTGAVTT SNYAN | 397 | GTNKRAP | 408 | ALWYSNHWV | 443 |
| CD3-18 | VH | RYTMH | 385 | YINPSRGYTNYNQK VKD | 412 | YYDDHYCLDY | 429 |
| | VL | SASSSVSYM N | 386 | DTSKLAS | 406 | QQWSSNPFT | 430 |
| CD3-19 | VH | RYTMH | 385 | YINPSRGYTNYNQK VKD | 412 | YYDDHYSLDY | 444 |
| | VL | SASSSVSYM N | 386 | DTSKLAS | 406 | QQWSSNPFT | 430 |

TABLE 12B-continued

| CD3 Binders - CDR sequences according to Kabat numbering scheme | | | | | | | |
|---|---|---|---|---|---|---|---|
| Binding Domain | Chain | CDR1 | SEQ ID NO: | CDR2 | SEQ ID NO: | CDR3 | SEQ ID NO: |
| CD3-20 | VH | GYTMN | 398 | LINPYKGVSTYNQKF KD | 418 | SGYYGDSDWYF DV | 445 |
| | VL | RASQDIRNY LN | 399 | YTSRLH | 419 | QQGNTLPWT | 446 |
| CD3-21 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |
| CD3-22 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-23 | VH | TYAMN | 387 | RIRSKANNYATYY ADSVKG | 420 | HGNFGDSYVS WFAY | 442 |
| | VL | GSSTGAVT TSNYAN | 397 | GTNKRAP | 408 | ALWYSNHWV | 443 |
| CD3-24 | VH | TYAMN | 387 | RIRSKYNNYATYY ADSVKG | 416 | HGNFGDEYVS WFAY | 447 |
| | VL | GSSTGAVT TSNYAN | 397 | GTNKRAP | 408 | ALWYSNHWV | 443 |
| CD3-25 | VH | TYAMN | 387 | RIRSKYNNYATYY ADSVKG | 416 | HGNFGDPYVS WFAY | 448 |
| | VL | GSSTGAVT TSNYAN | 397 | GTNKRAP | 408 | ALWYSNHWV | 443 |
| CD3-26 | VH | TYAMN | 387 | RIRSKYNNYATYY ADSVKG | 416 | HGNFGDSYVS WFDY | 449 |
| | VL | GSSTGAVT TSNYAN | 397 | GTNKRAP | 408 | ALWYSNHWV | 443 |
| CD3-27 | VH | TYAMS | 400 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-28 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-29 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-30 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-31 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-32 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-33 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-34 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |

TABLE 12B-continued

| | | | | | | |
|---|---|---|---|---|---|---|
| | | | CD3 Binders - CDR sequences according to Kabat numbering scheme | | | |
| Binding Domain | Chain | CDR1 | SEQ ID NO: | CDR2 | SEQ ID NO: | CDR3 | SEQ ID NO: |

| Binding Domain | Chain | CDR1 | SEQ ID NO: | CDR2 | SEQ ID NO: | CDR3 | SEQ ID NO: |
|---|---|---|---|---|---|---|---|
| CD3-35 | VH | TYAMH | 401 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-36 | VH | TYAMS | 400 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-37 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-38 | VH | TYAMN | 387 | RIRSKANNYYATY YADSVKG | 421 | HGNFGNSYVS WFAY | 431 |
| | VL | GSSTGAVT TSNYAN | 397 | GTNKRAP | 408 | ALWYSNLWV | 432 |
| CD3-39 | VH | TYAMN | 387 | RIRSKANSYATYY ADSVKG | 422 | HGNFGNSYVS WFAY | 431 |
| | VL | GSSTGAVT TSNYAN | 397 | GTNKRAP | 408 | ALWYSNLWV | 432 |
| CD3-40 | VH | TYAMN | 387 | RIRSKYNNYATAY ADSVKG | 423 | HGNFGNSYVS WFAY | 431 |
| | VL | GSSTGAVT TSNYAN | 397 | GTNKRAP | 408 | ALWYSNLWV | 432 |
| CD3-41 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-42 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-43 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-44 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-45 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-46 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-47 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-48 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-49 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |

TABLE 12B-continued

| Binding Domain | Chain | CDR1 | SEQ ID NO: | CDR2 | SEQ ID NO: | CDR3 | SEQ ID NO: |
|---|---|---|---|---|---|---|---|
| CD3-50 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNLWV | 432 |
| CD3-51 | VH | TYAMN | 387 | RIRSKYNNYATYY ADSVKG | 416 | HGNFGQSYVS WFAY | 450 |
| | VL | GSSTGAVT TSNYAN | 397 | GTNKRAP | 408 | ALWYSNLWV | 432 |
| CD3-52 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-53 | VH | TYAMN | 387 | RIRSKYNNYATYY ADSVKG | 416 | HGNFGNSYVS WFDY | 451 |
| | VL | GSSTGAVT TSNYAN | 397 | GTNKRAP | 408 | ALWYSNLWV | 432 |
| CD3-54 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-55 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-56 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-57 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-58 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-59 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-60 | VH | TYAMN | 387 | RIRSKYNNYATYY ADSVKG | 416 | HGNFGNSYVS WFAY | 431 |
| | VL | GSSTGAVT SSNYAN | 402 | GTNKRAP | 408 | ALWYSNLWV | 432 |
| CD3-61 | VH | TYAMN | 387 | RIRSKYNNYATYY ADSVKG | 416 | HGNFGNSYVS WFAY | 431 |
| | VL | GSSTGAVT SGHYAN | 403 | GTNKRAP | 408 | ALWYSNLWV | 432 |
| CD3-62 | VH | TYAMN | 387 | RIRSKYNNYATYY ADSVKG | 416 | HGNFGNSYVS WFAY | 431 |
| | VL | GSSTGAVT TSNYAN | 397 | DTNKRAP | 424 | ALWYSNLWV | 432 |
| CD3-63 | VH | TYAMN | 387 | RIRSKYNNYATYY ADSVKG | 416 | HGNFGNSYVS WFAY | 431 |
| | VL | GSSTGAVT TSNYAN | 397 | GTNNRAP | 425 | ALWYSNLWV | 432 |
| CD3-64 | VH | TYAMN | 387 | RIRSKYNNYATYY ADSVKG | 416 | HGNFGNSYVS WFAY | 431 |
| | VL | GSSTGAVT TSNYAN | 397 | GTNKRAS | 426 | ALWYSNLWV | 432 |

TABLE 12B-continued

| | | | | | | | | | |
|---|---|---|---|---|---|---|---|---|---|
| | | CD3 Binders - CDR sequences according to Kabat numbering scheme | | | | | | | |
| Binding Domain | Chain | CDR1 | SEQ ID NO: | CDR2 | SEQ ID NO: | CDR3 | SEQ ID NO: | | |
| CD3-65 | VH | TYAMN | 387 | RIRSKYNNYATYY ADSVKG | 416 | HGNFGNSYVS WFAY | 431 | | |
| | VL | GSSTGAVT TSNYAN | 397 | GTSNKHS | 427 | ALWYSNLWV | 432 | | |
| CD3-66 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-67 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-68 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-69 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-70 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-71 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-72 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-73 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | LLWYSNLWV | 452 | | |
| CD3-74 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNHWV | 443 | | |
| CD3-75 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |
| CD3-76 | VH | TYAMN | 387 | RIRSKYNNYATYY ADSVKG | 416 | HGNFGNSYVS WFAY | 431 | | |
| | VL | RSSTGAVT TSNYAN | 388 | GTNKRAP | 408 | ALWYSNLWV | 432 | | |
| CD3-77 | VH | TYAMN | 387 | RIRSKYNNYATYY ADSVKG | 416 | HGNFGNSYVS WFAY | 431 | | |
| | VL | KSSTGAVT TSNYAN | 404 | GTNKRAP | 408 | ALWYSNLWV | 432 | | |
| CD3-78 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNHWV | 443 | | |
| CD3-79 | VH | TYAMN | 387 | RIRSKYNNYATYY ADSVKG | 416 | HGNFGNSYVS WFAY | 431 | | |
| | VL | GSSTGAVT TSNYAN | 397 | GTNKRAP | 408 | ALWYSNLWV | 432 | | |

TABLE 12B-continued

| | | | | | | | | |
|---|---|---|---|---|---|---|---|---|
| CD3 Binders - CDR sequences according to Kabat numbering scheme | | | | | | | | |
| Binding Domain | Chain | CDR1 | SEQ ID NO: | CDR2 | SEQ ID NO: | CDR3 | SEQ ID NO: | |
| CD3-80 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-81 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-82 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-83 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-84 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-85 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-86 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-87 | VH | TYAMN | 387 | RIRSKYNNYATYY ADSVKG | 416 | HGNFGDSYVS WFAY | 442 | |
| | VL | GSSTGAVT TSNYAN | 397 | GTNKRAP | 408 | ALWYSNLWV | 432 | |
| CD3-88 | VH | TYAMN | 387 | RIRSKYNNYATYY ADSVKG | 416 | HGNFGDSYVS WFAY | 442 | |
| | VL | GSSTGAVT TSNYAN | 397 | GTNKRAP | 408 | ALWYSNLWV | 432 | |
| CD3-89 | VH | TYAMN | 387 | RIRSKANNYATYY ADSVKG | 420 | HGNFGDSYVS WFAY | 442 | |
| | VL | GSSTGAVT TSNYAN | 397 | GTNKRAP | 408 | ALWYSNLWV | 432 | |
| CD3-90 | VH | TYAMN | 387 | RIRSKYNNYATYY ADSVKG | 416 | HGNFGDSYVS WFDY | 449 | |
| | VL | GSSTGAVT TSNYAN | 397 | GTNKRAP | 408 | ALWYSNLWV | 432 | |
| CD3-91 | VH | TYAMS | 400 | RIRSKANNYATYY ADSVKG | 420 | HGNFGDSYVS WFDY | 449 | |
| | VL | GSSTGAVT TSNYAN | 397 | GTNKRAP | 408 | ALWYSNLWV | 432 | |
| CD3-92 | VH | TYAMN | 387 | RIRSNGGYSTYYA DSVKG | 428 | HGNFGNSYVS WFAY | 431 | |
| | VL | GSSTGAVT TSNYAN | 397 | GTNKRAP | 408 | ALWYSNLWV | 432 | |
| CD3-93 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |
| CD3-94 | VH | TYAMN | 387 | RIRSKYNNYATYY ADSVKG | 416 | HGNFGNSYVS WFAY | 431 | |
| | VL | GSSTGAVT TSNYAN | 397 | GTNKRAP | 408 | ALWYSNLWV | 432 | |

TABLE 12B-continued

| Binding Domain | Chain | CDR1 | SEQ ID NO: | CDR2 | SEQ ID NO: | CDR3 | SEQ ID NO: |
|---|---|---|---|---|---|---|---|
| CD3-95 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNLWV | 432 |
| CD3-96 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-97 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-98 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-99 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-100 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-101 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-102 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-103 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-104 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-105 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-106 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-107 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-108 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-109 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |

TABLE 12B-continued

| Binding Domain | Chain | CDR1 | SEQ ID NO: | CDR2 | SEQ ID NO: | CDR3 | SEQ ID NO: |
|---|---|---|---|---|---|---|---|
| CD3 Binders - CDR sequences according to Kabat numbering scheme | | | | | | | |
| CD3-110 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-111 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-112 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-113 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-114 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-115 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-116 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-117 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-118 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-119 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-120 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-121 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-122 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-123 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-124 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |

TABLE 12B-continued

| Binding Domain | Chain | CDR1 | SEQ ID NO: | CDR2 | SEQ ID NO: | CDR3 | SEQ ID NO: |
|---|---|---|---|---|---|---|---|
| CD3 Binders - CDR sequences according to Kabat numbering scheme | | | | | | | |
| CD3-125 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-126 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-127 | VH | TYAMN | 387 | RIRSKYNNYATYY ADSVKG | 416 | HGNFGNSYVS WFAY | 431 |
| | VL | GSSTGAVT TSNYAN | 397 | GTNKRAP | 408 | ALWYSNHWV | 443 |
| CD3-128 | VH | TYAMN | 387 | RIRSKYNNYATYY ADSVKG | 416 | HGNFGDSYVS WFAY | 442 |
| | VL | GSSTGAVT TSNYAN | 397 | GTNKRAP | 408 | ALWYSNHWV | 443 |
| CD3-129 | VH | TYAMN | 387 | RIRSKYNNYATYYA DSVKD | 407 | HGNFGNSYVS WFAH | 453 |
| | VL | GSSTGAVTS SNYAN | 402 | GTNKRAP | 408 | ALWYSNLWV | 432 |
| CD3-130 | VH | TYAMN | 387 | RIRSKYNNYATYYA DSVKD | 407 | HGNFGNSYVS WFAY | 431 |
| | VL | RSSTGAVTT SNYAN | 388 | GTNKRAP | 408 | ALWYSNLWV | 432 |

TABLE 12C

| Binding Domain | Chain | CDR1 | SEQ ID NO: | CDR2 | SEQ ID NO: | CDR3 | SEQ ID NO: |
|---|---|---|---|---|---|---|---|
| CD3 Binders - CDR sequences according to Chothia numbering scheme | | | | | | | |
| CD3-1 | VH | GYTFTRY | 454 | NPSRGY | 467 | YDDHYCLDY | 429 |
| | VL | SSSVSY | 455 | DTS | 468 | WSSNPF | 479 |
| CD3-2 | VH | GFTFNTY | 456 | RSKYNN YA | 469 | HGNFGNSYVS WFAY | 431 |
| | VL | STGAVTTSNY | 457 | GTN | 470 | WYSNLW | 480 |
| CD3-3 | VH | GYTFTSY | 458 | NPSSGY | 471 | WQDYDVYFDY | 433 |
| | VL | SSSVSY | 455 | ATS | 472 | WSSNPP | 481 |
| CD3-4 | VH | GYTFTRY | 454 | NPSRGY | 467 | YDDHYCLDY | 429 |
| | VL | SSSVSY | 455 | DTS | 468 | WSSNPL | 482 |
| CD3-5 | VH | GYTFTRY | 454 | NPSRGY | 467 | YDDHYCLDY | 429 |
| | VL | SSSVSY | 455 | DTS | 468 | WSSNPF | 479 |
| CD3-6 | VH | GFKFSGY | 459 | WYDGSK | 473 | QMGYWHFDL | 436 |
| | VL | SQSVSSY | 460 | DAS | 474 | RSNWPPL | 483 |
| CD3-7 | VH | GFTFSTY | 461 | RSKYNN YAT | 475 | HGNFGNSYVS WFA | 484 |
| | VL | STGAVTTSNY | 457 | GTN | 470 | WYSNLW | 480 |
| CD3-8 | VH | GYTFTRY | 454 | NPSRGY | 467 | YDDHYCLDY | 429 |
| | VL | SSSVSY | 455 | DTS | 468 | WSSNPL | 482 |
| CD3-9 | VH | GFTFNTY | 456 | RSKYNN YAT | 475 | HGNFGNSYVS WFA | 484 |
| | VL | STGAVTTSNY | 457 | GTN | 470 | WYSNLW | 480 |
| CD3-10 | VH | GFTFNTY | 456 | RSKYNN YA | 469 | HGNFGNSYVS WFAY | 431 |
| | VL | STGAVTTSNY | 457 | GTN | 470 | WYSNLW | 480 |

TABLE 12C-continued

| | | | | | | | |
|---|---|---|---|---|---|---|---|
| | | | SEQ ID | | SEQ ID | | SEQ ID |
| Binding Domain | Chain | CDR1 | NO: | CDR2 | NO: | CDR3 | NO: |
| CD3-11 | VH | GFTFNSY | 462 | RSKYNNYA | 469 | HGNFGNSYVS WWAY | 439 |
| | VL | STGAVTSGNY | 463 | GTK | 476 | WYSNRW | 485 |
| CD3-12 | VH | GFTFNKY | 464 | RSKYNNYA | 469 | HGNFGNSYISY WAY | 441 |
| | VL | STGAVTSGNY | 463 | GTK | 476 | WYSNRW | 485 |
| CD3-13 | VH | GYTFTRY | 454 | NPSRGY | 467 | YYDDHYCLDY | 429 |
| | VL | SSSVSY | 455 | DTS | 468 | WSSNPF | 479 |
| CD3-14 | VH | GFTFSTY | 461 | RSKYNNYA | 469 | HGNFGNSYVS WFAY | 431 |
| | VL | STGAVTTSNY | 457 | GTN | 470 | WYSNLW | 480 |
| CD3-15 | VH | GFTFNTY | 456 | RSKYNNYA | 469 | HGNFGNSYVS WFAY | 431 |
| | VL | STGAVTTSNY | 457 | GTN | 470 | WYSNLW | 480 |
| CD3-16 | VH | GFTFNTY | 456 | RSKYNNYA | 469 | HGNFGNSYVS WFAY | 431 |
| | VL | STGAVTTSNY | 457 | GTN | 470 | WYSNLW | 480 |
| CD3-17 | VH | GFTFSTY | 461 | RSKYNNYA | 469 | HGNFGDSYVS WFAY | 442 |
| | VL | STGAVTTSNY | 457 | GTN | 470 | WYSNHW | 486 |
| CD3-18 | VH | GYTFTRY | 454 | NPSRGY | 467 | YYDDHYCLDY | 429 |
| | VL | SSSVSY | 455 | DTS | 468 | WSSNPF | 479 |
| CD3-19 | VH | GYTFTRY | 454 | NPSRGY | 467 | YYDDHYSLDY | 444 |
| | VL | SSSVSY | 455 | DTS | 468 | WSSNPF | 479 |
| CD3-20 | VH | GYSFTGY | 465 | NPYKGV | 477 | SGYYGDSDWY FDV | 445 |
| | VL | SQDIRNY | 466 | YTS | 478 | GNTLPW | 487 |
| CD3-21 | VH | GFTFNTY | 456 | RSKYNNYA | 469 | HGNFGNSYVS WFAY | 431 |
| | VL | RSSTGAVTTSNYAN | 388 | GTNKRAP | 408 | ALWYSNLWV | 432 |

TABLE 12D

CD3 Binders - CDR sequences according to combination of Kabat and Chothia numbering schemes

| | | | | | | | |
|---|---|---|---|---|---|---|---|
| | | | SEQ ID | | SEQ ID | | SEQ ID |
| Binding Domain | Chain | CDR1 | NO: | CDR2 | NO: | CDR3 | NO: |
| CD3-1 | VH | GYTFTRYTMH | 488 | YINPSRGYTNYNQKFKD | 405 | YYDDHYCLDY | 429 |
| | VL | SASSSVSYMN | 386 | DTSKLAS | 406 | QQWSSNPFT | 430 |
| CD3-2 | VH | GFTFNTYAMN | 489 | RIRSKYNNYATYYADSVKD | 407 | HGNFGNSYVSWFAY | 431 |
| | VL | RSSTGAVTTSNYAN | 388 | GTNKRAP | 408 | ALWYSNLWV | 432 |
| CD3-3 | VH | GYTFTSYTMH | 490 | YINPSSGYTKYNQKFKD | 409 | WQDYDVYFDY | 433 |
| | VL | RASSSVSYMH | 390 | ATSNLAS | 410 | QQWSSNPPT | 434 |
| CD3-4 | VH | GYTFTRYTMH | 488 | YINPSRGYTNYNQKFKD | 405 | YYDDHYCLDY | 429 |
| | VL | RASSSVSYMN | 391 | DTSKVAS | 411 | QQWSSNPLT | 435 |

TABLE 12D-continued

| Binding Domain | Chain | CDR1 | SEQ ID NO: | CDR2 | SEQ ID NO: | CDR3 | SEQ ID NO: |
|---|---|---|---|---|---|---|---|
| CD3-5 | VH | GYTFTRYTMH | 488 | YINPSRGYTNYNQKVKD | 412 | YYDDHYCLDY | 429 |
| | VL | SASSSVSYMN | 386 | DTSKLAS | 406 | QQWSSNPFT | 430 |
| CD3-6 | VH | GFKFSGYGMH | 491 | VIWYDGSKKYYVDSVKG | 413 | QMGYWHFDL | 436 |
| | VL | RASQSVSSYLA | 393 | DASNRAT | 414 | QQRSNWPPLT | 437 |
| CD3-7 | VH | GFTFSTYAMN | 492 | RIRSKYNNYATYYADSVK | 496 | HGNFGNSYVSWFAY | 431 |
| | VL | RSSTGAVTTSNYAN | 388 | GTNKRAP | 408 | ALWYSNLWV | 432 |
| CD3-8 | VH | GYTFTRYTMH | 488 | YINPSRGYTNYNQKFKD | 405 | YYDDHYCLDY | 429 |
| | VL | RASSSVSYMN | 391 | DTSKVAS | 411 | QQWSSNPLT | 435 |
| CD3-9 | VH | GFTFNTYAMN | 489 | RIRSKYNNYATYYADSVK | 496 | HGNFGNSYVSWFAY | 431 |
| | VL | RSSTGAVTTSNYAN | 388 | GTNKRAP | 408 | ALWYSNLWV | 432 |
| CD3-10 | VH | GFTFNTYAMN | 489 | RIRSKYNNYATYYADSVKD | 407 | HGNFGNSYVSWFAY | 431 |
| | VL | RSSTGAVTTSNYAN | 388 | GTNKRAP | 408 | ALWYSNLWV | 432 |
| CD3-11 | VH | GFTFNSYAMN | 493 | RIRSKYNNYATYYADSVKG | 416 | HGNFGNSYVSWWAY | 439 |
| | VL | GSSTGAVTSGNYPN | 395 | GTKFLAP | 417 | VLWYSNRWV | 440 |
| CD3-12 | VH | GFTFNKYAMN | 494 | RIRSKYNNYATYYADSVKD | 407 | HGNFGNSYISYWAY | 441 |
| | VL | GSSTGAVTSGNYPN | 395 | GTKFLAP | 417 | VLWYSNRWV | 440 |
| CD3-13 | VH | GYTFTRYTMH | 488 | YINPSRGYTNYNQKFKD | 405 | YYDDHYCLDY | 429 |
| | VL | SASSSVSYMN | 386 | DTSKLAS | 406 | QQWSSNPFT | 430 |
| CD3-14 | VH | GFTFSTYAMN | 492 | RIRSKYNNYATYYADSVKD | 407 | HGNFGNSYVSWFAY | 431 |
| | VL | RSSTGAVTTSNYAN | 388 | GTNKRAP | 408 | ALWYSNLWW | 432 |
| CD3-15 | VH | GFTFNTYAMN | 489 | RIRSKYNNYATYYADSVKD | 407 | HGNFGNSYVSWFAY | 431 |
| | VL | RSSTGAVTTSNYAN | 388 | GTNKRAP | 408 | ALWYSNLWW | 432 |
| CD3-16 | VH | GFTFNTYAMN | 489 | RIRSKYNNYATYYADSVKG | 416 | HGNFGNSYVSWFAY | 431 |
| | VL | GSSTGAVTTSNYAN | 397 | GTNKRAP | 408 | ALWYSNLWW | 432 |
| CD3-17 | VH | GFTFSTYAMN | 492 | RIRSKYNNYATYYADSVKG | 416 | HGNFGDSYVSWFAY | 442 |
| | VL | GSSTGAVTTSNYAN | 397 | GTNKRAP | 408 | ALWYSNHWV | 443 |
| CD3-18 | VH | GYTFTRYTMH | 488 | YINPSRGYTNYNQKVKD | 412 | YYDDHYCLDY | 429 |
| | VL | SASSSVSYMN | 386 | DTSKLAS | 406 | QQWSSNPFT | 430 |
| CD3-19 | VH | GYTFTRYTMH | 488 | YINPSRGYTNYNQKVKD | 412 | YYDDHYSLDY | 444 |
| | VL | SASSSVSYMN | 386 | DTSKLAS | 406 | QQWSSNPFT | 430 |

TABLE 12D-continued

CD3 Binders - CDR sequences according to combination of Kabat
and Chothia numbering schemes

| Binding Domain | Chain | CDR1 | SEQ ID NO: | CDR2 | SEQ ID NO: | CDR3 | SEQ ID NO: |
|---|---|---|---|---|---|---|---|
| CD3-20 | VH | GYSFTGYTM N | 495 | LINPYKGVSTYNQ KFKD | 418 | SGYYGDSDW YFDV | 445 |
| | VL | RASQDIRNYL N | 399 | YTSRLHS | 497 | QQGNTLPWT | 446 |

In some embodiments, a MBM (e.g., a TBM) can comprise a CD3 ABM which comprises the CDRs of any of CD3-1 to CD3-130 as defined by Kabat numbering (e.g., as set forth in Table 12B). In other embodiments, a MBM (e.g., a TBM) can comprise a CD3 ABM which comprises the CDRs of any of CD3-1 to CD3-130 as defined by Chothia numbering (e.g., as set forth in Table 12C). In yet other embodiments, a MBM (e.g., a TBM) can comprise a CD3 ABM which comprises the CDRs of any of CD3-1 to CD3-130 as defined by a combination of Kabat and Chothia numbering (e.g., as set forth in Table 12D).

In some embodiments, a CD3 ABM comprises the CDR sequences of CD3-1. In some embodiments, a CD3 ABM comprises the CDR sequences of CD3-2. In some embodiments, a CD3 ABM comprises the CDR sequences of CD3-3. In some embodiments, a CD3 ABM comprises the CDR sequences of CD3-4. In some embodiments, a CD3 ABM comprises the CDR sequences of CD3-5. In some embodiments, a CD3 ABM comprises the CDR sequences of CD3-6. In some embodiments, a CD3 ABM comprises the CDR sequences of CD3-7. In some embodiments, a CD3 ABM comprises the CDR sequences of CD3-8. In some embodiments, a CD3 ABM comprises the CDR sequences of CD3-9. In some embodiments, a CD3 ABM comprises the CDR sequences of CD3-10. In some embodiments, a CD3 ABM comprises the CDR sequences of CD3-11. In some embodiments, a CD3 ABM comprises the CDR sequences of CD3-12. In some embodiments, a CD3 ABM comprises the CDR sequences of CD3-13. In some embodiments, a CD3 ABM comprises the CDR sequences of CD3-14. In some embodiments, a CD3 ABM comprises the CDR sequences of CD3-15. In some embodiments, a CD3 ABM comprises the CDR sequences of CD3-16. In some embodiments, a CD3 ABM comprises the CDR sequences of CD3-17. In some embodiments, a CD3 ABM comprises the CDR sequences of CD3-18. In some embodiments, a CD3 ABM comprises the CDR sequences of CD3-19. In some embodiments, a CD3 ABM comprises the CDR sequences of CD3-20. In some embodiments, a CD3 ABM comprises the CDR sequences of CD3-21. In some embodiments, a CD3 ABM comprises the CDR sequences of CD3-22. In some embodiments, a CD3 ABM comprises the CDR sequences of CD3-23. In some embodiments, a CD3 ABM comprises the CDR sequences of CD3-24. In some embodiments, a CD3 ABM comprises the CDR sequences of CD3-25. In some embodiments, a CD3 ABM comprises the CDR sequences of CD3-26. In some embodiments, a CD3 ABM comprises the CDR sequences of CD3-27. In some embodiments, a CD3 ABM comprises the CDR sequences of CD3-28. In some embodiments, a CD3 ABM comprises the CDR sequences of CD3-29. In some embodiments, a CD3 ABM comprises the CDR sequences of CD3-30. In some embodiments, a CD3 ABM comprises the CDR sequences of CD3-31. In some embodiments, a CD3 ABM comprises the CDR sequences of CD3-32. In some embodiments, a CD3 ABM comprises the CDR sequences of CD3-33. In some embodiments, a CD3 ABM comprises the CDR sequences of CD3-34. In some embodiments, a CD3 ABM comprises the CDR sequences of CD3-35. In some embodiments, a CD3 ABM comprises the CDR sequences of CD3-36. In some embodiments, a CD3 ABM comprises the CDR sequences of CD3-37. In some embodiments, a CD3 ABM comprises the CDR sequences of CD3-38. In some embodiments, a CD3 ABM comprises the CDR sequences of CD3-39. In some embodiments, a CD3 ABM comprises the CDR sequences of CD3-40. In some embodiments, a CD3 ABM comprises the CDR sequences of CD3-41. In some embodiments, a CD3 ABM comprises the CDR sequences of CD3-42. In some embodiments, a CD3 ABM comprises the CDR sequences of CD3-43. In some embodiments, a CD3 ABM comprises the CDR sequences of CD3-44. In some embodiments, a CD3 ABM comprises the CDR sequences of CD3-45. In some embodiments, a CD3 ABM comprises the CDR sequences of CD3-46. In some embodiments, a CD3 ABM comprises the CDR sequences of CD3-47. In some embodiments, a CD3 ABM comprises the CDR sequences of CD3-48. In some embodiments, a CD3 ABM comprises the CDR sequences of CD3-49. In some embodiments, a CD3 ABM comprises the CDR sequences of CD3-50. In some embodiments, a CD3 ABM comprises the CDR sequences of CD3-51. In some embodiments, a CD3 ABM comprises the CDR sequences of CD3-52. In some embodiments, a CD3 ABM comprises the CDR sequences of CD3-53. In some embodiments, a CD3 ABM comprises the CDR sequences of CD3-54. In some embodiments, a CD3 ABM comprises the CDR sequences of CD3-55. In some embodiments, a CD3 ABM comprises the CDR sequences of CD3-56. In some embodiments, a CD3 ABM comprises the CDR sequences of CD3-57. In some embodiments, a CD3 ABM comprises the CDR sequences of CD3-58. In some embodiments, a CD3 ABM comprises the CDR sequences of CD3-59. In some embodiments, a CD3 ABM comprises the CDR sequences of CD3-60. In some embodiments, a CD3 ABM comprises the CDR sequences of CD3-61. In some embodiments, a CD3 ABM comprises the CDR sequences of CD3-62. In some embodiments, a CD3 ABM comprises the CDR sequences of CD3-63. In some embodiments, a CD3 ABM comprises the CDR sequences of CD3-64. In some embodiments, a CD3 ABM comprises the CDR sequences of CD3-65. In some embodiments, a CD3 ABM comprises the CDR sequences of CD3-66. In some embodiments, a CD3 ABM comprises the CDR sequences of CD3-67. In some embodiments, a CD3 ABM comprises the CDR sequences of CD3-68. In some embodiments, a CD3 ABM comprises the CDR sequences of CD3-69. In some embodiments, a CD3 ABM comprises the CDR sequences of CD3-70. In some embodiments, a CD3 ABM comprises the CDR sequences of CD3-71. In some embodiments, a CD3 ABM comprises the CDR sequences of CD3-72. In some embodiments, a CD3 ABM comprises the CDR sequences of CD3-73. In some embodiments, a CD3 ABM comprises the CDR sequences of CD3-74. In some embodiments, a CD3 ABM comprises the CDR sequences of CD3-75. In some embodiments, a CD3 ABM comprises the CDR sequences of CD3-76. In some embodiments, a CD3 ABM comprises the CDR sequences of CD3-77. In some embodiments, a CD3 ABM comprises the CDR sequences of CD3-78. In some embodiments, a CD3 ABM comprises the CDR sequences of CD3-79. In some embodiments, a CD3 ABM comprises the CDR sequences of CD3-80. In some embodiments, a CD3 ABM comprises the CDR sequences of CD3-81. In some embodiments, a CD3 ABM comprises the CDR sequences of CD3-82. In some embodiments, a CD3 ABM comprises the CDR sequences of CD3-83. In some embodiments, a CD3 ABM comprises the CDR sequences of CD3-84. In some embodiments, a CD3 ABM comprises the CDR sequences of CD3-85. In some embodiments, a CD3 ABM comprises the CDR sequences of CD3-86. In some embodiments, a CD3 ABM comprises the CDR sequences of CD3-87. In some embodiments, a CD3 ABM comprises the CDR sequences of CD3-88. In some embodiments, a CD3 ABM comprises the CDR sequences of CD3-89. In some embodiments, a CD3 ABM comprises the CDR sequences of CD3-90. In some embodiments, a CD3 ABM comprises the CDR sequences of CD3-91. In some embodiments, a CD3 ABM comprises the CDR sequences of CD3-92. In some embodiments, a CD3 ABM comprises the CDR sequences of CD3-93. In some embodiments, a CD3 ABM comprises the CDR sequences of CD3-94. In some embodiments, a CD3 ABM comprises the CDR sequences of CD3-95. In some embodiments, a CD3 ABM comprises the CDR sequences of CD3-96. In some embodiments, a CD3 ABM comprises the CDR sequences of CD3-97. In some embodiments, a CD3 ABM comprises the CDR sequences of CD3-98. In some embodiments, a CD3 ABM comprises the CDR sequences of CD3-99. In some embodiments, a CD3 ABM comprises the CDR sequences of CD3-100. In some embodiments, a CD3 ABM comprises the CDR sequences of CD3-101. In some embodiments, a CD3 ABM comprises the CDR sequences of CD3-102. In some embodiments, a CD3 ABM comprises the CDR sequences of CD3-103. In some embodiments, a CD3 ABM comprises the CDR sequences of CD3-104. In some embodiments, a CD3 ABM comprises the CDR sequences of CD3-105. In some embodiments, a CD3 ABM comprises the CDR sequences of CD3-106. In some embodiments, a CD3 ABM comprises the CDR sequences of CD3-107. In some embodiments, a CD3 ABM comprises the CDR sequences of CD3-108. In some embodiments, a CD3 ABM comprises the CDR sequences of CD3-109. In some embodiments, a CD3 ABM comprises the CDR sequences of CD3-110. In some embodiments, a CD3 ABM comprises the CDR sequences of CD3-111. In some embodiments, a CD3 ABM comprises the CDR sequences of CD3-112. In some embodiments, a CD3 ABM comprises the CDR sequences of CD3-113. In some embodiments, a CD3 ABM comprises the CDR sequences of CD3-114. In some embodiments, a CD3 ABM comprises the CDR sequences of CD3-115. In some embodiments, a CD3 ABM comprises the CDR sequences of CD3-116. In some embodiments, a CD3 ABM comprises the CDR sequences of CD3-117. In some embodiments, a CD3 ABM comprises the CDR sequences of CD3-118. In some embodiments, a CD3 ABM comprises the CDR sequences of CD3-119. In some embodiments, a CD3 ABM comprises the CDR sequences of CD3-120. In some embodiments, a CD3 ABM comprises the CDR sequences of CD3-121. In some embodiments, a CD3 ABM comprises the CDR sequences of CD3-122. In some embodiments, a CD3 ABM comprises the CDR sequences of CD3-123. In some embodiments, a CD3 ABM comprises the CDR sequences of CD3-124. In some embodiments, a CD3 ABM comprises the CDR sequences of CD3-125. In some embodiments, a CD3 ABM comprises the CDR sequences of CD3-126. In some embodiments, a CD3 ABM comprises the CDR sequences of CD3-127. In some embodiments, a CD3 ABM comprises the CDR sequences of CD3-128. In some embodiments, a CD3 ABM comprises the CDR sequences of CD3-129. In some embodiments, a CD3 ABM comprises the CDR sequences of CD3-130.

A MBM (e.g., a TBM) can comprise the complete heavy and light variable sequences of any one of CD3-1 to CD3-130. In some embodiments, a MBM comprises a CD3 ABM which comprises the VH and VL sequences of CD3-1. In some embodiments, a MBM comprises a CD3 ABM which comprises the VH and VL sequences of CD3-1. In some embodiments, a MBM comprises a CD3 ABM which comprises the VH and VL sequences of CD3-2. In some embodiments, a MBM comprises a CD3 ABM which comprises the VH and VL sequences of CD3-3. In some embodiments, a MBM comprises a CD3 ABM which comprises the VH and VL sequences of CD3-4. In some embodiments, a MBM comprises a CD3 ABM which comprises the VH and VL sequences of CD3-5. In some embodiments, a MBM comprises a CD3 ABM which comprises the VH and VL sequences of CD3-6. In some embodiments, a MBM comprises a CD3 ABM which comprises the VH and VL sequences of CD3-7. In some embodiments, a MBM comprises a CD3 ABM which comprises the VH and VL sequences of CD3-8. In some embodiments, a MBM comprises a CD3 ABM which comprises the VH and VL sequences of CD3-9. In some embodiments, a MBM comprises a CD3 ABM which comprises the VH and VL sequences of CD3-10. In some embodiments, a MBM comprises a CD3 ABM which comprises the VH and VL sequences of CD3-11. In some embodiments, a MBM comprises a CD3 ABM which comprises the VH and VL sequences of CD3-12. In some embodiments, a MBM comprises a CD3 ABM which comprises the VH and VL sequences of CD3-13. In some embodiments, a MBM comprises a CD3 ABM which comprises the VH and VL sequences of CD3-14. In some embodiments, a MBM comprises a CD3 ABM which comprises the VH and VL sequences of CD3-15. In some embodiments, a MBM comprises a CD3 ABM which comprises the VH and VL sequences of CD3-16. In some embodiments, a MBM comprises a CD3 ABM which comprises the VH and VL sequences of CD3-17. In some embodiments, a MBM comprises a CD3 ABM which comprises the VH and VL sequences of CD3-18. In some embodiments, a MBM comprises a CD3 ABM which comprises the VH and VL sequences of CD3-19. In some embodiments, a MBM comprises a CD3 ABM which comprises the VH and VL sequences of CD3-20. In some embodiments, a MBM comprises a CD3 ABM which comprises the VH and VL sequences of CD3-21. In some embodiments, a MBM comprises a CD3 ABM which comprises the VH and VL sequences of CD3-22. In some embodiments, a MBM comprises a CD3 ABM which comprises the VH and VL sequences of CD3-23. In some embodiments, a MBM comprises a CD3 ABM which comprises the VH and VL sequences of CD3-24. In some embodiments, a MBM comprises a CD3 ABM which comprises the VH and VL sequences of CD3-25. In some embodiments, a MBM comprises a CD3 ABM which comprises the VH and VL sequences of CD3-26. In some embodiments, a MBM comprises a CD3 ABM which comprises the VH and VL sequences of CD3-27. In some embodiments, a MBM comprises a CD3 ABM which comprises the VH and VL sequences of CD3-28. In some embodiments, a MBM comprises a CD3 ABM which comprises the VH and VL sequences of CD3-129. In some embodiments, a MBM comprises a CD3 ABM which comprises the VH and VL sequences of CD3-130.

In addition to the CDR sets described in Tables 12B-12D (i.e., the set of six CDRs for each of CD3-1 to CD3-130), the present disclosure provides variant CDR sets. In one embodiment, a set of 6 CDRs can have 1, 2, 3, 4 or 5 amino acid changes from a CDR set described in Tables 12B-12D, as long as the CD3 ABM is still able to bind to the target antigen, as measured by at least one of a Biacore, surface plasmon resonance (SPR) and/or BLI (biolayer interferometry, e.g., Octet assay) assay.

In addition to the variable heavy and variable light domains disclosed in Table 12A that form an ABM to CD3, the present disclosure provides variant VH and VL domains. In one embodiment, the variant VH and VL domains each can have from 1, 2, 3, 4, 5, 6, 7, 8, 9 or 10 amino acid changes from the VH and VL domain set forth in Table 12A, as long as the ABM is still able to bind to the target antigen, as measured at least one of a Biacore, surface plasmon resonance (SPR) and/or BLI (biolayer interferometry, e.g., Octet assay) assay. In another embodiment, the variant VH and VL are at least 90, 95, 97, 98 or 99% identical to the respective VH or VL disclosed in Table 12A, as long as the ABM is still able to bind to the target antigen, as measured by at least one of a Biacore, surface plasmon resonance (SPR) and/or BLI (biolayer interferometry, e.g., Octet assay) assay.

In some embodiments, a MBM can comprise an ABM which is a CD3 binding molecule as described in WO 2020/052692 or an antigen-binding domain thereof. Table AA to Table AJ-2 (collectively "Table A") list sequences of CD3 binding molecules that can be included in CD3 binding ABMs.

TABLE AA

| Consensus Group No. C1 Heavy Chain and Light Chain CDR Consensus Sequences | | | |
|---|---|---|---|
| CDR | Binder | Sequence | SEQ ID NO: |
| CDR-H1 | C1-1 | $GFX_1FX_2KX_3GMX_4$ | 573 |
| CDR-H1 | C1-2 | $GFX_1FX_2KX_3G$ | 574 |
| CDR-H1 | C1-3 | $KX_3GMX_4$ | 575 |
| CDR-H1 | C1-4 | $GFX_1FX_2KX_3$ | 576 |
| CDR-H2 | C1-5 | $X_5IYYDSSX_6MYYADTVKG$ | 577 |
| CDR-H2 | C1-6 | $YYDSSX_6$ | 578 |
| CDR-H2 | C1-7 | $IYYDSSX_6M$ | 579 |
| CDR-H3 | C1-8 | $X_{55}X_8X_9DLDFDX_{10}$ | 580 |
| CDR-H3 | C1-9 | $AX_7X_{55}X_8X_9DLDFDX_{10}$ | 581 |
| CDR-H3 | C1-10 | AALNSEYD | 582 |

TABLE AA-continued

| Consensus Group No. C1 Heavy Chain and Light Chain CDR Consensus Sequences | | | |
|---|---|---|---|
| CDR | Binder | Sequence | SEQ ID NO: |
| CDR-H3 | C1-11 | LNSEYD | 583 |
| CDR-L1 | C1-12 | $RX_{11}SQSX_{12}X_{13}X_{14}SX_{15}X_{16}TTYFN$ | 584 |
| CDR-L1 | C1-13 | $QSX_{12}X_{13}X_{14}SX_{15}TTY$ | 585 |
| CDR-L1 | C1-14 | $SQSX_{12}X_{13}X_{14}SX_{15}X_{16}TTY$ | 586 |
| CDR-L1 | C1-15 | $RX_{11}SQSX_{12}X_{13}X_{14}SX_{15}X_{16}$ | 587 |
| CDR-L1 | C1-16 | $SQSX_{12}X_{13}X_{14}S$ | 588 |
| CDR-L1 | C1-17 | $QSX_{12}X_{13}X_{14}S$ | 589 |
| CDR-L2 | C1-18 | $X_{17}X_{18}SX_{19}X_{20}X_{21}X_{22}$ | 590 |
| CDR-L2 | C1-19 | $X_{17}X_{18}S$ | 591 |
| CDR-L3 | C1-20 | $LQX_{23}X_{24}X_{25}X_{26}PX_{27}T$ | 592 |
| CDR-L3 | C1-21 | $X_{23}X_{24}X_{25}X_{26}PX_{27}$ | 593 |
| CDR-L3 | C1-22 | $LQX_{23}X_{24}X_{25}$ | 594 |
| CDR-L3 | C1-23 | $LQX_{23}X_{24}X_{25}X_{26}PX_{27}$ | 595 |

$X_1$ is T or A;
$X_2$ is S or R;
$X_3$ is N, Y, or Q;
$X_4$ is H or S;
$X_5$ is M or L;
$X_6$ is K or R;
$X_7$ is S or K;
$X_{55}$ is F, Y, or S;
$X_8$ is W, Y, S, or T;
$X_9$ is W, Y, S, or T;
$X_{10}$ is H or Y;
$X_{11}$ is S or G;
$X_{12}$ is I or L;
$X_{13}$ is V or G;
$X_{14}$ is R or N;
$X_{15}$ is D, E, or L;
$X_{16}$ is G, N, or E;
$X_{17}$ is R or S;
$X_{18}$ is V or T;
$X_{19}$ is N or T;
$X_{20}$ is R or L;
$X_{21}$ is F or E;
$X_{22}$ is S or Y;
$X_{23}$ is S or Y;
$X_{24}$ is S or A;
$X_{25}$ is H or T;
$X_{26}$ is F or Y;
$X_{27}$ is W or Y

TABLE AB

| Consensus Group No. C2 Heavy Chain and Light Chain CDR Consensus Sequences | | | |
|---|---|---|---|
| CDR | Binder | Sequence | SEQ ID NO: |
| CDR-H1 | C2-1 | $GFSLTTYNX_{28}H$ | 596 |
| CDR-H1 | C2-2 | GFSLTTYN | 597 |
| CDR-H1 | C2-3 | $TYNX_{28}H$ | 598 |
| CDR-H1 | C2-4 | GFSLTTY | 599 |
| CDR-H2 | C2-5 | $RMRYSGDTSX_{29}X_{30}X_{31}ALX_{32}S$ | 600 |

TABLE AB-continued

Consensus Group No. C2 Heavy Chain and Light Chain CDR Consensus Sequences

| CDR | Binder | Sequence | SEQ ID NO: |
|---|---|---|---|
| CDR-H2 | C2-6 | RYSGD | 601 |
| CDR-H2 | C2-7 | MRYSGDT | 602 |
| CDR-H3 | C2-8 | DPMYIPX$_{35}$YX$_{36}$YGVMNA | 603 |
| CDR-H3 | C2-9 | X$_{33}$X$_{34}$DPMYIPX$_{35}$YX$_{36}$YGVMNA | 604 |
| CDR-L1 | C2-10 | KX$_{37}$SQNIX$_{38}$X$_{39}$YLN | 605 |
| CDR-L1 | C2-11 | SQNIX$_{38}$X$_{39}$Y | 606 |
| CDR-L1 | C2-12 | QNIX$_{38}$X$_{39}$Y | 607 |
| CDR-L2 | C2-13 | NTX$_{40}$X$_{41}$LX$_{42}$AGVP | 608 |
| CDR-L2 | C2-14 | NTX$_{40}$X$_{41}$LX$_{42}$A | 609 |
| CDR-L2 | C2-15 | NTX$_{40}$ | 610 |
| CDR-L3 | C2-16 | LQHRSX$_{43}$YT | 611 |
| CDR-L3 | C2-17 | HRSX$_{43}$Y | 612 |

X$_{28}$ is V or I;
X$_{29}$ is F or Y;
X$_{30}$ is N or S;
X$_{31}$ is A or S;
X$_{32}$ is T or K;
X$_{33}$ is T or A;
X$_{34}$ is S or R;
X$_{35}$ is N or G;
X$_{36}$ is S or A;
X$_{37}$ is A, T, or S;
X$_{38}$ is N or D;
X$_{39}$ is N or K;
X$_{40}$ is D or N;
X$_{41}$ is H or N;
X$_{42}$ is Q or E;
X$_{43}$ is R, S, or G

TABLE AC

Consensus Group No. C3 Heavy Chain and Light Chain CDR Consensus Sequences

| CDR | Binder | Sequence | SEQ ID NO: |
|---|---|---|---|
| CDR-H1 | C3-1 | GYTFTSYYIY | 613 |
| CDR-H1 | C3-2 | GYTFTSYY | 614 |
| CDR-H1 | C3-3 | SYYIY | 615 |
| CDR-H1 | C3-4 | GYTFTSY | 458 |
| CDR-H2 | C3-5 | YIYPX$_{44}$X$_{45}$X$_{46}$X$_{47}$IYYSEX$_{48}$FKG | 616 |
| CDR-H2 | C3-6 | YPX$_{44}$X$_{45}$X$_{46}$X$_{47}$ | 617 |
| CDR-H2 | C3-7 | IYPX$_{44}$X$_{45}$X$_{46}$X$_{47}$I | 618 |
| CDR-H3 | C3-8 | X$_{49}$RPX$_{50}$TMMAPLX$_{51}$X$_{52}$ | 619 |
| CDR-H3 | C3-9 | PX$_{50}$TMMAPLX$_{51}$X$_{52}$ | 620 |
| CDR-L1 | C3-10 | RSSQSLX$_{53}$YSX$_{54}$GNTYLH | 621 |
| CDR-L1 | C3-11 | SQSLX$_{53}$YSX$_{54}$GNTY | 622 |
| CDR-L1 | C3-12 | QSLX$_{53}$YSX$_{54}$GNTY | 623 |
| CDR-L2 | C3-13 | RVSNRFS | 624 |
| CDR-L2 | C3-14 | RVS | 625 |
| CDR-L3 | C3-15 | FQSTHLPYT | 626 |
| CDR-L3 | C3-16 | STHLPY | 627 |

X$_{44}$ is G or A;
X$_{45}$ is H or N;
X$_{46}$ is D or G;
X$_{47}$ is A or G;
X$_{48}$ is N or K;
X$_{49}$ is V or A;
X$_{50}$ is N or V;
X$_{51}$ is A or V;
X$_{52}$ is Y or F;
X$_{53}$ is I or V;
X$_{54}$ is I or H

TABLE AD-1

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| NOV292 | KNGMH | 628 | MIYYDSSKMYY ADTVKG | 634 | FWWDLDFDH | 641 |
| NOV123 | SYYIY | 615 | YIYPGHDAIYYS ENFKG | 635 | PNTMMAPLA Y | 642 |
| Sp10b | SYYIY | 615 | YIYPGHDAIYYS ENFKG | 635 | PNTMMAPLA Y | 642 |
| NOV453 | TYNVH | 629 | RMRYSGDTSF NAALTS | 636 | DPMYIPNYSY GVMNA | 643 |
| NOV229 | TYNVH | 629 | RMRYSGDTSF NAALTS | 636 | DPMYIPNYSY GVMNA | 643 |
| NOV110 | SYYIY | 615 | YIYPANGGIYYS EKFKG | 637 | PVTMMAPLV F | 644 |
| NOV832 | SYYIY | 615 | YIYPANGGIYYS EKFKG | 637 | PVTMMAPLV F | 644 |

TABLE AD-1-continued

CD3 Binders- Heavy Chain CDR sequences according to Kabat
numbering scheme

| Binder | CDR-H1 | SEQ ID NO: | CDR-H2 | SEQ ID NO: | CDR-H3 | SEQ ID NO: |
|---|---|---|---|---|---|---|
| NOV589 | KNGMH | 628 | MIYYDSSRMYY ADTVKG | 638 | FWWDLDFDY | 645 |
| NOV580 | TYNIH | 630 | RMRYSGDTSY SSALKS | 639 | DPMYIPGYSY GVMNA | 646 |
| NOV567 | KYGMS | 631 | LIYYDSSKMNY ADTVKG | 640 | LNSEYD | 583 |
| NOV221 | TYNIH | 630 | RMRYSGDTSY SSALKS | 639 | DPMYIPGYSY GVMNA | 646 |
| CD3_sp11a_bkm1 | KNGMH | 628 | MIYYDSSKMYY ADTVKG | 634 | FWWDLDFDH | 641 |
| CD3_SP11a_bkm2 | KNGMH | 628 | MIYYDSSKMYY ADTVKG | 634 | FWWDLDFDH | 641 |
| CD3_sp11a_hz0 | KNGMH | 628 | MIYYDSSKMYY ADTVKG | 634 | FWWDLDFDH | 641 |
| CD3_SP11A_HZ1 | KNGMH | 628 | MIYYDSSKMYY ADTVKG | 634 | FWWDLDFDH | 641 |
| CD3_sp11a_sansPTM_ hz1 | KQGMH | 632 | MIYYDSSKMYY ADTVKG | 634 | FWWDLDFDH | 641 |
| CD3_sp11a_sansPTM_ rat | KQGMH | 632 | MIYYDSSKMYY ADTVKG | 634 | FWWDLDFDH | 641 |
| CD3_sp11a_VHVL_ YY | KNGMH | 628 | MIYYDSSKMYY ADTVKG | 634 | FYYDLDFDH | 647 |
| CD3_SP11A_VHVL_ SS | KNGMH | 628 | MIYYDSSKMYY ADTVKG | 634 | FSSDLDFDH | 648 |
| CD3_SP11A_VHVL_ WS | KNGMH | 628 | MIYYDSSKMYY ADTVKG | 634 | FWSDLDFDH | 649 |
| CD3_sp11a_VHVL_ SW | KNGMH | 628 | MIYYDSSKMYY ADTVKG | 634 | FSWDLDFDH | 650 |
| CD3_SP11A_VHVL_ TT | KNGMH | 628 | MIYYDSSKMYY ADTVKG | 634 | FTTDLDFDH | 651 |
| CD3_SP11A_VHVL_ TW | KNGMH | 628 | MIYYDSSKMYY ADTVKG | 634 | FTWDLDFDH | 652 |
| CD3_SP11A_VHVL_ WT | KNGMH | 628 | MIYYDSSKMYY ADTVKG | 634 | FWTDLDFDH | 653 |
| CD3_SP11A VH3_ VLK_3 | KNGMH | 628 | MIYYDSSKMYY ADTVKG | 634 | FWWDLDFDH | 641 |
| CD3_sp11a_VH1_VK2 | KNQMH | 633 | MIYYDSSKMYY ADTVKG | 634 | FWWDLDFDH | 641 |
| CD3_SP11A_VH3_VLK1 | KNGMH | 628 | MIYYDSSKMYY ADTVKG | 634 | FWWDLDFDH | 641 |
| CD3_SP11A_VH5_VK2 | KQGMH | 632 | MIYYDSSKMYY ADTVKG | 634 | FWWDLDFDH | 641 |
| CD3_sp9aFW1_VL_VH_ S56G | TYNVH | 629 | RMRYSGDTSF NAALTS | 636 | DPMYIPNYAY GVMNA | 654 |
| CD3_SP9AFW4_VL_ VH_S56G | TYNVH | 629 | RMRYSGDTSF NAALTS | 636 | DPMYIPNYAY GVMNA | 654 |
| CD3_sp9aFW1_VLVH | TYNVH | 629 | RMRYSGDTSF NAALTS | 636 | DPMYIPNYAY GVMNA | 654 |
| CD3_sp9aFW4_VLVH | TYNVH | 629 | RMRYSGDTSF NAALTS | 636 | DPMYIPNYAY GVMNA | 654 |

TABLE AD-1-continued

CD3 Binders- Heavy Chain CDR sequences according to Kabat
numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp9arabtor_VHVL | TYNVH | 629 | RMRYSGDTSF NAALTS | 636 | DPMYIPNYAY GVMNA | 654 |
| CD3_sp9arabtor_VLVH | TYNVH | 629 | RMRYSGDTSF NAALTS | 636 | DPMYIPNYAY GVMNA | 654 |
| CD3_sp11a_VHVL_ YY_SANSPTM | KNGMH | 628 | MIYYDSSKMYY ADTVKG | 634 | FYYDLDFDH | 647 |
| CD3_sp11a_VHVL_ YY_SANSPTM_Y | KNGMH | 628 | MIYYDSSKMYY ADTVKG | 634 | YYYDLDFDH | 655 |
| CD3_sp11a_VHVL_ YY_SANSPTM_S | KNGMH | 628 | MIYYDSSKMYY ADTVKG | 634 | SYYDLDFDH | 656 |
| CD3_sp11a_VHVL_ YY_Y | KNGMH | 628 | MIYYDSSKMYY ADTVKG | 634 | YYYDLDFDH | 655 |
| CD3_sp11a_VHVL_ YY_s | KNGMH | 628 | MIYYDSSKMYY ADTVKG | 634 | SYYDLDFDH | 656 |
| CD3_sp11a_VHVL_ SS_SANSPTM | KNGMH | 628 | MIYYDSSKMYY ADTVKG | 634 | FSSDLDFDH | 648 |
| CD3_sp11a_VHVL_ SS_SANSPTM_Y | KNGMH | 628 | MIYYDSSKMYY ADTVKG | 634 | YSSDLDFDH | 657 |
| CD3_sp11a_VHVL_SS_ SANSPTM_S | KNGMH | 628 | MIYYDSSKMYY ADTVKG | 634 | SSSDLDFDH | 658 |
| CD3_sp11a_VHVL_SS_ Y | KNGMH | 628 | MIYYDSSKMYY ADTVKG | 634 | YSSDLDFDH | 657 |
| CD3_sp11a_VHVL_SS_ S | KNGMH | 628 | MIYYDSSKMYY ADTVKG | 634 | SSSDLDFDH | 658 |
| CD3_sp11a_VHVL_ SS _SANSPTM | KNGMH | 628 | MIYYDSSKMYY ADTVKG | 634 | FSSDLDFDH | 648 |
| CD3_sp11a_VHVL_ WS _SANSPTM_Y | KNGMH | 628 | MIYYDSSKMYY ADTVKG | 634 | YWSDLDFDH | 659 |
| CD3_sp11a_VHVL_ WS _SANSPTM_S | KNGMH | 628 | MIYYDSSKMYY ADTVKG | 634 | SWSDLDFDH | 660 |
| CD3_sp11a_VHVL_ WS_Y | KNGMH | 628 | MIYYDSSKMYY ADTVKG | 634 | YWSDLDFDH | 659 |
| CD3_sp11a_VHVL_ WS_S | KNGMH | 628 | MIYYDSSKMYY ADTVKG | 634 | SWSDLDFDH | 660 |
| CD3_sp11a_VHVL_ WS _SANSPTM | KNGMH | 628 | MIYYDSSKMYY ADTVKG | 634 | FWSDLDFDH | 649 |
| CD3_sp11a_VHVL_ SW_SANSPTM_Y | KNGMH | 628 | MIYYDSSKMYY ADTVKG | 634 | YSWDLDFDH | 661 |
| CD3_sp11a_VHVL_ SW_SANSPTM_S | KNGMH | 628 | MIYYDSSKMYY ADTVKG | 634 | SSWDLDFDH | 662 |
| CD3_sp11a_VHVL_ SW_Y | KNGMH | 628 | MIYYDSSKMYY ADTVKG | 634 | YSWDLDFDH | 661 |
| CD3_sp11a_VHVL_ SW_S | KNGMH | 628 | MIYYDSSKMYY ADTVKG | 634 | SSWDLDFDH | 662 |
| CD3_sp11a_VHVL_ SW_SANSPTM | KNGMH | 628 | MIYYDSSKMYY ADTVKG | 634 | FSWDLDFDH | 650 |
| CD3_sp11a_VHVL_ TW_SANSPTM_Y | KNGMH | 628 | MIYYDSSKMYY ADTVKG | 634 | YTWDLDFDH | 663 |

TABLE AD-1-continued

CD3 Binders- Heavy Chain CDR sequences according to Kabat
numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_ TW_SANSPTM_S | KNGMH | 628 | MIYYDSSKMYY ADTVKG | 634 | STWDLDFDH | 664 |
| CD3_sp11a_VHVL_ TW_Y | KNGMH | 628 | MIYYDSSKMYY ADTVKG | 634 | YTWDLDFDH | 663 |
| CD3_sp11a_VHVL_ TW_S | KNGMH | 628 | MIYYDSSKMYY ADTVKG | 634 | STWDLDFDH | 664 |
| CD3_sp11a_VHVL_ TW_SANSPTM | KNGMH | 628 | MIYYDSSKMYY ADTVKG | 634 | FTWDLDFDH | 652 |
| CD3_sp11a_VHVL_ TT _SANSPTM_Y | KNGMH | 628 | MIYYDSSKMYY ADTVKG | 634 | YTTDLDFDH | 665 |
| CD3_sp11a_VHVL_T T_SANSPTM_S | KNGMH | 628 | MIYYDSSKMYY ADTVKG | 634 | STTDLDFDH | 666 |
| CD3_sp11a_VHVL_T T_Y | KNGMH | 628 | MIYYDSSKMYY ADTVKG | 634 | YTTDLDFDH | 665 |
| CD3_sp11a_VHVL_T T_S | KNGMH | 628 | MIYYDSSKMYY ADTVKG | 634 | STTDLDFDH | 666 |
| CD3_sp11a_VHVL_T T_SANSPTM | KNGMH | 628 | MIYYDSSKMYY ADTVKG | 634 | FTTDLDFDH | 651 |
| CD3_SP11AVH3_VLK_ 3_Y | KNGMH | 628 | MIYYDSSKMYY ADTVKG | 634 | YWWDLDFDH | 667 |
| CD3_SP11AVH3_VLK_ 3_S | KNGMH | 628 | MIYYDSSKMYY ADTVKG | 634 | SWWDLDFDH | 668 |
| CD3_SP11AVH3_VLK_ 3_Y_PTM | KNGMH | 628 | MIYYDSSKMYY ADTVKG | 634 | YWWDLDFDH | 667 |
| CD3_SP11AVH3_VLK_ 3_S_PTM | KNGMH | 628 | MIYYDSSKMYY ADTVKG | 634 | SWWDLDFDH | 668 |
| CD3_SP11AVH3_VLK_ 3_Y_SW | KNGMH | 628 | MIYYDSSKMYY ADTVKG | 634 | YSWDLDFDH | 661 |
| CD3_SP11AVH3_VLK_ 3_S_SW | KNGMH | 628 | MIYYDSSKMYY ADTVKG | 634 | SSWDLDFDH | 662 |
| CD3_SP11AVH3_VL_K 3_Y_PTM_SW | KNGMH | 628 | MIYYDSSKMYY ADTVKG | 634 | YSWDLDFDH | 661 |
| CD3_SP11AVH3_VLK_ 3_S_SWPTM | KNGMH | 628 | MIYYDSSKMYY ADTVKG | 634 | SSWDLDFDH | 662 |
| CD3_SP11AVH3_VLK_ SWPTM | KNGMH | 628 | MIYYDSSKMYY ADTVKG | 634 | FSWDLDFDH | 650 |
| CD3_SP11AVH3_VLK_ 3_SW | KNGMH | 628 | MIYYDSSKMYY ADTVKG | 634 | FSWDLDFDH | 650 |
| CD3_sp11a_VH1_VK2_ Y | KNQMH | 633 | MIYYDSSKMYY ADTVKG | 634 | YWWDLDFDH | 667 |
| CD3_sp11a_VH1_VK2_ S | KNQMH | 633 | MIYYDSSKMYY ADTVKG | 634 | SWWDLDFDH | 668 |
| CD3_sp11a_VH1_VK2_ Y_PTM | KNQMH | 633 | MIYYDSSKMYY ADTVKG | 634 | YWWDLDFDH | 667 |
| CD3_sp11a_VH1_VK2_ S_PTM | KNQMH | 633 | MIYYDSSKMYY ADTVKG | 634 | SWWDLDFDH | 668 |
| CD3_sp11a_VH1_VK2_ Y_SW | KNQMH | 633 | MIYYDSSKMYY ADTVKG | 634 | YSWDLDFDH | 661 |
| CD3_sp11a_VH1_VK2_ S_SW | KNQMH | 633 | MIYYDSSKMYY ADTVKG | 634 | SSWDLDFDH | 662 |

TABLE AD-1-continued

CD3 Binders- Heavy Chain CDR sequences according to Kabat
numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VH1_VK2_Y_PTM | KNQMH | 633 | MIYYDSSKMYY ADTVKG | 634 | YSWDLDFDH | 661 |
| CD3_sp11a_VH1_VK2_S_PTM_SW | KNQMH | 633 | MIYYDSSKMYY ADTVKG | 634 | SSWDLDFDH | 662 |
| CD3_sp11a_VH1_VK2_SW | KNQMH | 633 | MIYYDSSKMYY ADTVKG | 634 | FSWDLDFDH | 650 |
| CD3_sp11a_VH1_VK2_SW_PTM | KNQMH | 633 | MIYYDSSKMYY ADTVKG | 634 | FSWDLDFDH | 650 |
| CD3_SP11A_VH3_VLK1_Y | KNGMH | 628 | MIYYDSSKMYY ADTVKG | 634 | YWWDLDFDH | 667 |
| CD3_SP11A_VH3_VLK1_S | KNGMH | 628 | MIYYDSSKMYY ADTVKG | 634 | SWWDLDFDH | 668 |
| CD3_SP11A_VH3_VLK1_Y_PTM | KNGMH | 628 | MIYYDSSKMYY ADTVKG | 634 | YWWDLDFDH | 667 |
| CD3_SP11A_VH3_VLK1_S_PTM | KNGMH | 628 | MIYYDSSKMYY ADTVKG | 634 | SWWDLDFDH | 668 |
| CD3_SP11A_VH3_VLK1_Y_SW | KNGMH | 628 | MIYYDSSKMYY ADTVKG | 634 | YSWDLDFDH | 661 |
| CD3_SP11A_VH3_VLK1_S_SW | KNGMH | 628 | MIYYDSSKMYY ADTVKG | 634 | SSWDLDFDH | 662 |
| CD3_SP11A_VH3_VLK1_Y_PTM | KNGMH | 628 | MIYYDSSKMYY ADTVKG | 634 | YWWDLDFDH | 667 |
| CD3_SP11A_VH3_VLK1_S_PTM_SW | KNGMH | 628 | MIYYDSSKMYY ADTVKG | 634 | SSWDLDFDH | 662 |
| CD3_SP11A_VH3_VLK1_PTM_SW | KNGMH | 628 | MIYYDSSKMYY ADTVKG | 634 | FSWDLDFDH | 650 |
| CD3_SP11A_VH3_VLK1_SW | KNGMH | 628 | MIYYDSSKMYY ADTVKG | 634 | FSWDLDFDH | 650 |
| CD3_SP11A_VH5_VK2_Y | KQGMH | 632 | MIYYDSSKMYY ADTVKG | 634 | YWWDLDFDH | 667 |
| CD3_SP11A_VH5_VK2_S | KQGMH | 632 | MIYYDSSKMYY ADTVKG | 634 | SWWDLDFDH | 668 |
| CD3_SP11A_VH5_VK2_Y_PTM | KQGMH | 632 | MIYYDSSKMYY ADTVKG | 634 | YWWDLDFDH | 667 |
| CD3_SP11A_VH5_VK2_S_PTM | KQGMH | 632 | MIYYDSSKMYY ADTVKG | 634 | SWWDLDFDH | 668 |
| CD3_SP11A_VH5_VK2_Y_SW | KQGMH | 632 | MIYYDSSKMYY ADTVKG | 634 | YSWDLDFDH | 661 |
| CD3_SP11A_VH5_VK2_S_SW | KQGMH | 632 | MIYYDSSKMYY ADTVKG | 634 | SSWDLDFDH | 662 |
| CD3_SP11A_VH5_VK2_Y_PTM_SW | KQGMH | 632 | MIYYDSSKMYY ADTVKG | 634 | YSWDLDFDH | 661 |
| CD3_SP11A_VH5_VK2_S_PTM_SW | KQGMH | 632 | MIYYDSSKMYY ADTVKG | 634 | SSWDLDFDH | 662 |
| CD3_SP11A_VH5_VK2_PTM_SW | KQGMH | 632 | MIYYDSSKMYY ADTVKG | 634 | FSWDLDFDH | 650 |
| CD3_SP11A_VH5_VK2_SW | KQGMH | 632 | MIYYDSSKMYY ADTVKG | 634 | FSWDLDFDH | 650 |

TABLE AD-2

| Binder | CDR-L1 | SEQ ID NO: | CDR-L2 | SEQ ID NO: | CDR-L3 | SEQ ID NO: |
|---|---|---|---|---|---|---|
| NOV292 | RSSQSLVRSD GTTYFN | 669 | RVSNR FS | 624 | LQSSHFP WT | 680 |
| NOV123 | RSSQSLIYSIGN TYLH | 670 | RVSNR FS | 624 | FQSTHLP YT | 626 |
| Sp10b | RSSQSLIYSIGN TYLH | 670 | RVSNR FS | 624 | FQSTHLP YT | 626 |
| NOV453 | KASQNINNYLN | 671 | NTDHL QA | 677 | LQHRSR YT | 681 |
| NOV229 | KASQNINNYLN | 671 | NTDHL QA | 677 | LQHRSR YT | 681 |
| NOV110 | RSSQSLVYSHG NTYLH | 672 | RVSNR FS | 624 | FQSTHLP YT | 626 |
| NOV832 | RSSQSLVYSHG NTYLH | 672 | RVSNR FS | 624 | FQSTHLP YT | 626 |
| NOV589 | RSSQSLVRSD GTTYFN | 669 | RVSNR FS | 624 | LQSSHFP WT | 680 |
| NOV580 | KTSQNIDKYLN | 673 | NTNNL EA | 678 | LQHRSSY T | 682 |
| NOV567 | RGSQSIGNSLN | 674 | STSTL EY | 679 | LQYATYP YT | 683 |
| NOV221 | KSSQNIDKYLN | 675 | NTNNL EA | 678 | LQHRSG YT | 684 |
| CD3_sp11a_bkm1 | RSSQSLVRSD GTTYFN | 669 | RVSNR FS | 624 | LQSSHFP WT | 680 |
| CD3_SP11a_bkm2 | RSSQSLVRSD GTTYFN | 669 | RVSNR FS | 624 | LQSSHFP WT | 680 |
| CD3_sp11a_hz0 | RSSQSLVRSD GTTYFN | 669 | RVSNR FS | 624 | LQSSHFP WT | 680 |
| CD3_SP11A_HZ1 | RSSQSLVRSD GTTYFN | 669 | RVSNR FS | 624 | LQSSH | 685 |
| CD3_sp11a_sansPTM_hz1 | RSSQSLVRSEG TTYFN | 676 | RVSNR FS | 624 | LQSSHFP WT | 680 |
| CD3_sp11a_sansPTM_rat | RSSQSLVRSEG TTYFN | 676 | RVSNR FS | 624 | LQSSHFP WT | 680 |
| CD3_sp11a_VHVL_YY | RSSQSLVRSD GTTYFN | 669 | RVSNR FS | 624 | LQSSHFP WT | 680 |
| CD3_SP11A_VHVL_SS | RSSQSLVRSD GTTYFN | 669 | RVSNR FS | 624 | LQSSHFP WT | 680 |
| CD3_SP11A_VHVL_WS | RSSQSLVRSD GTTYFN | 669 | RVSNR FS | 624 | LQSSHFP WT | 680 |
| CD3_sp11a_VHVL_SW | RSSQSLVRSD GTTYFN | 669 | RVSNR FS | 624 | LQSSHFP WT | 680 |
| CD3_SP11A_VHVL_TT | RSSQSLVRSD GTTYFN | 669 | RVSNR FS | 624 | LQSSHFP WT | 680 |
| CD3_SP11A_VHVL_TW | RSSQSLVRSD GTTYFN | 669 | RVSNR FS | 624 | LQSSHFP WT | 680 |
| CD3_SP11A_VHVL_WT | RSSQSLVRSD GTTYFN | 669 | RVSNR FS | 624 | LQSSHFP WT | 680 |
| CD3_SP11A_VH3_VLK_3 | RSSQSLVRSEG TTYFN | 676 | RVSNR FS | 624 | LQSSHFP WT | 680 |

TABLE AD-2-continued

CD3 Binders- Light Chain CDR sequences according to Kabat
numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2 | RSSQSLVRSD GTTYFN | 669 | RVSNR FS | 624 | LQSSHFP WT | 680 |
| CD3_SP11A_VH3_VLK1 | RSSQSLVRSEG TTYFN | 676 | RVSNR FS | 624 | LQSSHFP WT | 680 |
| CD3_SP11A_VH5_VK2 | RSSQSLVRSD GTTYFN | 669 | RVSNR FS | 624 | LQSSHFP WT | 680 |
| CD3_sp9aFW1 _VL_VH_S56G | KASQNINNYLN | 671 | NTDHL QA | 677 | LQHRSR YT | 681 |
| CD3_SP9AFW4_VL_VH_S56G | KASQNINNYLN | 671 | NTDHL QA | 677 | LQHRSR YT | 681 |
| CD3_sp9aFW1_VLVH | KASQNINNYLN | 671 | NTDHL QA | 677 | LQHRSR YT | 681 |
| CD3_sp9aFW4_VLVH | KASQNINNYLN | 671 | NTDHL QA | 677 | LQHRSR YT | 681 |
| CD3_sp9arabtor_VHVL | KASQNINNYLN | 671 | NTDHL QA | 677 | LQHRSR YT | 681 |
| CD3_sp9arabtor_VLVH | KASQNINNYLN | 671 | NTDHL QA | 677 | LQHRSR YT | 681 |
| CD3_sp11a_VHVL_YY_ SANSPTM | RSSQSLVRSEG TTYFN | 676 | RVSNR FS | 624 | LQSSHFP WT | 680 |
| CD3_sp11a_VHVL_YY_ NSASPTM_Y | RSSQSLVRSEG TTYFN | 676 | RVSNR FS | 624 | LQSSHFP WT | 680 |
| CD3_sp11 a_VHVL_YY_ SANSPTM_S | RSSQSLVRSEG TTYFN | 676 | RVSNR FS | 624 | LQSSHFP WT | 680 |
| CD3_sp11a_VHVL_YY_Y | RSSQSLVRSD GTTYFN | 669 | RVSNR FS | 624 | LQSSHFP WT | 680 |
| CD3_sp11a_VHVL_YY_s | RSSQSLVRSD GTTYFN | 669 | RVSNR FS | 624 | LQSSHFP WT | 680 |
| CD3_sp11a_VHVL_SS_ SANSPTM | RSSQSLVRSEG TTYFN | 676 | RVSNR FS | 624 | LQSSHFP WT | 680 |
| CD3_sp11a_VHVL_SS_ SANSPTM_Y | RSSQSLVRSEG TTYFN | 676 | RVSNR FS | 624 | LQSSHFP WT | 680 |
| CD3_sp11a_VHVL_SS_ SANSPTM_S | RSSQSLVRSEG TTYFN | 676 | RVSNR FS | 624 | LQSSHFP WT | 680 |
| CD3_sp11a_VHVL_SS_Y | RSSQSLVRSD GTTYFN | 669 | RVSNR FS | 624 | LQSSHFP WT | 680 |
| CD3_sp11a_VHVL_SS_S | RSSQSLVRSD GTTYFN | 669 | RVSNR FS | 624 | LQSSHFP WT | 680 |
| CD3_sp11a_VHVL_SS_ SANSPTM | RSSQSLVRSEG TTYFN | 676 | RVSNR FS | 624 | LQSSHFP WT | 680 |
| CD3_sp11a_VHVL_WS_ SANSPTM_Y | RSSQSLVRSEG TTYFN | 676 | RVSNR FS | 624 | LQSSHFP WT | 680 |
| CD3_sp11a_VHVL_WS_ SANSPTM_S | RSSQSLVRSEG TTYFN | 676 | RVSNR FS | 624 | LQSSHFP WT | 680 |
| CD3_sp11a_VHVL_ WS _Y | RSSQSLVRSD GTTYFN | 669 | RVSNR FS | 624 | LQSSHFP WT | 680 |
| CD3_sp11a_VHVL_ WS _S | RSSQSLVRSD GTTYFN | 669 | RVSNR FS | 624 | LQSSHFP WT | 680 |

TABLE AD-2-continued

CD3 Binders- Light Chain CDR sequences according to Kabat
numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_WS_SANSPTM | RSSQSLVRSEG TTYFN | 676 | RVSNR FS | 624 | LQSSHFP WT | 680 |
| CD3_sp11a_VHVL_SW_SANSPTM_Y | RSSQSLVRSEG TTYFN | 676 | RVSNR FS | 624 | LQSSHFP WT | 680 |
| CD3_sp11a_VHVL_SW_SANSPTM_S | RSSQSLVRSEG TTYFN | 676 | RVSNR FS | 624 | LQSSHFP WT | 680 |
| CD3_sp11a_VHVL_SW_Y | RSSQSLVRSD GTTYFN | 669 | RVSNR FS | 624 | LQSSHFP WT | 680 |
| CD3_sp11a_VHVL_SW_S | RSSQSLVRSD GTTYFN | 669 | RVSNR FS | 624 | LQSSHFP WT | 680 |
| CD3_sp11a_VHVL_SW_SANSPTM | RSSQSLVRSEG TTYFN | 676 | RVSNR FS | 624 | LQSSHFP WT | 680 |
| CD3_sp11a_VHVL_TW_SANSPTM_Y | RSSQSLVRSEG TTYFN | 676 | RVSNR FS | 624 | LQSSHFP WT | 680 |
| CD3_sp11a_VHVL_TW_SANSPTM_S | RSSQSLVRSEG TTYFN | 676 | RVSNR FS | 624 | LQSSHFP WT | 680 |
| CD3_sp11a_VHVL_TW_Y | RSSQSLVRSD GTTYFN | 669 | RVSNR FS | 624 | LQSSHFP WT | 680 |
| CD3_sp11a_VHVL_TW_S | RSSQSLVRSD GTTYFN | 669 | RVSNR FS | 624 | LQSSHFP WT | 680 |
| CD3_sp11a_VHVL_TW_SANSPTM | RSSQSLVRSEG TTYFN | 676 | RVSNR FS | 624 | LQSSHFP WT | 680 |
| CD3_sp11a_VHVL_TT_SANSPTM_Y | RSSQSLVRSEG TTYFN | 676 | RVSNR FS | 624 | LQSSHFP WT | 680 |
| CD3_sp11a_VHVL_TT_SANSPTM_S | RSSQSLVRSEG TTYFN | 676 | RVSNR FS | 624 | LQSSHFP WT | 680 |
| CD3_sp11a_VHVL_TT_Y | RSSQSLVRSD GTTYFN | 669 | RVSNR FS | 624 | LQSSHFP WT | 680 |
| CD3_sp11a_VHVL_TT_S | RSSQSLVRSD GTTYFN | 669 | RVSNR FS | 624 | LQSSHFP WT | 680 |
| CD3_sp11a_VHVL_TT_SANSPTM | RSSQSLVRSEG TTYFN | 676 | RVSNR FS | 624 | LQSSHFP WT | 680 |
| CD3_SP11AVH3_VLK_3_Y | RSSQSLVRSEG TTYFN | 676 | RVSNR FS | 624 | LQSSHFP WT | 680 |
| CD3_SP11AVH3_VLK_3_S | RSSQSLVRSEG TTYFN | 676 | RVSNR FS | 624 | LQSSHFP WT | 680 |
| CD3_SP11AVH3_VLK_3_Y_PTM | RSSQSLVRSD GTTYFN | 669 | RVSNR FS | 624 | LQSSHFP WT | 680 |
| CD3_SP11AVH3_VLK_3_S_PTM | RSSQSLVRSD GTTYFN | 669 | RVSNR FS | 624 | LQSSHFP WT | 680 |
| CD3_SP11AVH3_VLK_3_Y_SW | RSSQSLVRSEG TTYFN | 676 | RVSNR FS | 624 | LQSSHFP WT | 680 |
| CD3_SP11AVH3_VLK_3_S_SW | RSSQSLVRSEG TTYFN | 676 | RVSNR FS | 624 | LQSSHFP WT | 680 |
| CD3_SP11AVH3_VLK_3_Y_PTM_SW | RSSQSLVRSD GTTYFN | 669 | RVSNR FS | 624 | LQSSHFP WT | 680 |
| CD3_SP11AVH3_VLK_3_S_SWPTM | RSSQSLVRSD GTTYFN | 669 | RVSNR FS | 624 | LQSSHFP WT | 680 |
| CD3_SP11AVH3_VLK_SWPTM | RSSQSLVRSD GTTYFN | 669 | RVSNR FS | 624 | LQSSHFP WT | 680 |

TABLE AD-2-continued

CD3 Binders- Light Chain CDR sequences according to Kabat
numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11AVH3_VLK_3_SW | RSSQSLVRSEG TTYFN | 676 | RVSNR FS | 624 | LQSSHFP WT | 680 |
| CD3_sp11a_VH1_VK2_Y | RSSQSLVRSD GTTYFN | 669 | RVSNR FS | 624 | LQSSHFP WT | 680 |
| CD3_sp11a_VH1_VK2_S | RSSQSLVRSD GTTYFN | 669 | RVSNR FS | 624 | LQSSHFP WT | 680 |
| CD3_sp11a_VH1_VK2_Y_ PTM | RSSQSLVRSEG TTYFN | 676 | RVSNR FS | 624 | LQSSHFP WT | 680 |
| CD3_sp11a_VH1_VK2_S_ PTM | RSSQSLVRSEG TTYFN | 676 | RVSNR FS | 624 | LQSSHFP WT | 680 |
| CD3_sp11a_VH1_VK2_Y_ sw | RSSQSLVRSD GTTYFN | 669 | RVSNR FS | 624 | LQSSHFP WT | 680 |
| CD3_sp11a_VH1_VK2_S_ SW | RSSQSLVRSD GTTYFN | 669 | RVSNR FS | 624 | LQSSHFP WT | 680 |
| CD3_sp11a_VH1_VK2_Y_ PTM | RSSQSLVRSEG TTYFN | 676 | RVSNR FS | 624 | LQSSHFP WT | 680 |
| CD3_sp11a_VH1_VK2_S_ PTM_SW | RSSQSLVRSEG TTYFN | 676 | RVSNR FS | 624 | LQSSHFP WT | 680 |
| CD3_sp11a_VH1_VK2_SW | RSSQSLVRSD GTTYFN | 669 | RVSNR FS | 624 | LQSSHFP WT | 680 |
| CD3_sp11a_VH1_VK2_SW_ PTM | RSSQSLVRSEG TTYFN | 676 | RVSNR FS | 624 | LQSSHFP WT | 680 |
| CD3_SP11A_VH3_VLK1_Y | RSSQSLVRSEG TTYFN | 676 | RVSNR FS | 624 | LQSSHFP WT | 680 |
| CD3_SP11A_VH3_VLK1_S | RSSQSLVRSEG TTYFN | 676 | RVSNR FS | 624 | LQSSHFP WT | 680 |
| CD3_SP11A_VH3_VLK1_Y_ PTM | RSSQSLVRSD GTTYFN | 669 | RVSNR FS | 624 | LQSSHFP WT | 680 |
| CD3_SP11A_VH3_VLK1_S_ PTM | RSSQSLVRSD GTTYFN | 669 | RVSNR FS | 624 | LQSSHFP WT | 680 |
| CD3_SP11A_VH3_VLK1_Y_ SW | RSSQSLVRSEG TTYFN | 676 | RVSNR FS | 624 | LQSSHFP WT | 680 |
| CD3_SP11A_VH3_VLK1_S_ SW | RSSQSLVRSEG TTYFN | 676 | RVSNR FS | 624 | LQSSHFP WT | 680 |
| CD3_SP11A_VH3_VLK1_Y_ PTM | RSSQSLVRSD GTTYFN | 669 | RVSNR FS | 624 | LQSSHFP WT | 680 |
| CD3_SP11A_VH3_VLK1_S_ PTM_SW | RSSQSLVRSD GTTYFN | 669 | RVSNR FS | 624 | LQSSHFP WT | 680 |
| CD3_SP11A_VH3_VLK1_ PTM_SW | RSSQSLVRSD GTTYFN | 669 | RVSNR FS | 624 | LQSSHFP WT | 680 |
| CD3_SP11A_VH3_VLK1_ SW | RSSQSLVRSEG TTYFN | 676 | RVSNR FS | 624 | LQSSHFP WT | 680 |
| CD3_SP11A_VH5_VK2_Y | RSSQSLVRSD GTTYFN | 669 | RVSNR FS | 624 | LQSSHFP WT | 680 |
| CD3_SP11A_VH5_VK2_S | RSSQSLVRSD GTTYFN | 669 | RVSNR FS | 624 | LQSSHFP WT | 680 |
| CD3_SP11A_VH5_VK2_Y_ PTM | RSSQSLVRSD GTTYFN | 669 | RVSNR FS | 624 | LQSSHFP WT | 680 |

TABLE AD-2-continued

| CD3 Binders- Light Chain CDR sequences according to Kabat numbering scheme | | | | | | |
|---|---|---|---|---|---|---|
| Binder | CDR-L1 | SEQ ID NO: | CDR-L2 | SEQ ID NO: | CDR-L3 | SEQ ID NO: |
| CD3_SP11A_VH5_VK2_S_PTM | RSSQSLVRSD GTTYFN | 669 | RVSNR FS | 624 | LQSSHFP WT | 680 |
| CD3_SP11A_VH5_VK2_Y_sw | RSSQSLVRSD GTTYFN | 669 | RVSNR FS | 624 | LQSSHFP WT | 680 |
| CD3_SP11A_VH5_VK2_S_SW | RSSQSLVRSD GTTYFN | 669 | RVSNR FS | 624 | LQSSHFP WT | 680 |
| CD3_SP11A_VH5_VK2_Y_PTM_SW | RSSQSLVRSD GTTYFN | 669 | RVSNR FS | 624 | LQSSHFP WT | 680 |
| CD3_SP11A_VH5_VK2_S_PTM_SW | RSSQSLVRSD GTTYFN | 669 | RVSNR FS | 624 | LQSSHFP WT | 680 |
| CD3_SP11A_VH5_VK2_PTM_SW | RSSQSLVRSD GTTYFN | 669 | RVSNR FS | 624 | LQSSHFP WT | 680 |
| CD3_SP11A_VH5_VK2_SW | RSSQSLVRSD GTTYFN | 669 | RVSNR FS | 624 | LQSSHFP WT | 680 |

TABLE AE-1

| CD3 Binders- Heavy Chain CDR sequences according to Chothia numbering scheme | | | | | | |
|---|---|---|---|---|---|---|
| Binder | CDR-H1 | SEQ ID NO: | CDR-H2 | SEQ ID NO: | CDR-H3 | SEQ ID NO: |
| NOV292 | GFTFSKN | 686 | YYDSSK | 689 | FWWDLDFDH | 641 |
| NOV123 | GYTFTSY | 458 | YPGHDA | 690 | PNTMMAPLAY | 642 |
| Sp10b | GYTFTSY | 458 | YPGHDA | 690 | PNTMMAPLAY | 642 |
| NOV453 | GFSLTTY | 599 | RYSGD | 601 | DPMYIPNYSYG VMNA | 643 |
| NOV229 | GFSLTTY | 599 | RYSGD | 601 | DPMYIPNYSYG VMNA | 643 |
| NOV110 | GYTFTSY | 458 | YPANGG | 691 | PVTMMAPLVF | 644 |
| NOV832 | GYTFTSY | 458 | YPANGG | 691 | PVTMMAPLVF | 644 |
| NOV589 | GFTFSKN | 686 | YYDSSR | 692 | FWWDLDFDY | 645 |
| NOV580 | GFSLTTY | 599 | RYSGD | 601 | DPMYIPGYSYG VMNA | 646 |
| NOV567 | GFAFRKY | 687 | YYDSSK | 689 | LNSEYD | 583 |
| NOV221 | GFSLTTY | 599 | RYSGD | 601 | DPMYIPGYSYG VMNA | 646 |
| CD3_sp11a_bkm1 | GFTFSKN | 686 | YYDSSK | 689 | FWWDLDFDH | 641 |
| CD3_SP11a_bkm2 | GFTFSKN | 686 | YYDSSK | 689 | FWWDLDFDH | 641 |
| CD3_sp11a_hz0 | GFTFSKN | 686 | YYDSSK | 689 | FWWDLDFDH | 641 |
| CD3_SP11A_HZ1 | GFTFSKN | 686 | YYDSSK | 689 | FWWDLDFDH | 641 |
| CD3_sp11a_sansPTM_hz1 | GFTFSKQ | 688 | YYDSSK | 689 | FWWDLDFDH | 641 |
| CD3_sp11a_sansPTM_rat | GFTFSKQ | 688 | YYDSSK | 689 | FWWDLDFDH | 641 |
| CD3_sp11a_VHVL_YY | GFTFSKN | 686 | YYDSSK | 689 | FYYDLDFDH | 647 |
| CD3_SP11A_VHVL_SS | GFTFSKN | 686 | YYDSSK | 689 | FSSDLDFDH | 648 |

TABLE AE-1-continued

CD3 Binders- Heavy Chain CDR sequences according to Chothia
numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11A_VHVL_WS | GFTFSKN | 686 | YYDSSK | 689 | FWSDLDFDH | 649 |
| CD3_sp11a_VHVL_SW | GFTFSKN | 686 | YYDSSK | 689 | FSWDLDFDH | 650 |
| CD3_SP11A_VHVL_TT | GFTFSKN | 686 | YYDSSK | 689 | FTTDLDFDH | 651 |
| CD3_SP11A_VHVL_TW | GFTFSKN | 686 | YYDSSK | 689 | FTWDLDFDH | 652 |
| CD3_SP11A_VHVL_WT | GFTFSKN | 686 | YYDSSK | 689 | FWTDLDFDH | 653 |
| CD3_SP11A_VH3_VLK_3 | GFTFSKN | 686 | YYDSSK | 689 | FWWDLDFDH | 641 |
| CD3_sp11a_VH1_VK2 | GFTFSKQ | 688 | YYDSSK | 689 | FWWDLDFDH | 641 |
| CD3_SP11A_VH3_VLK1 | GFTFSKN | 686 | YYDSSK | 689 | FWWDLDFDH | 641 |
| CD3_SP11A_VH5_VK2 | GFTFSKQ | 688 | YYDSSK | 689 | FWWDLDFDH | 641 |
| CD3_sp9aFW1_VL_VH_S56G | GFSLTTY | 599 | RYSGD | 601 | DPMYIPNYAYG VMNA | 654 |
| CD3_SP9AFW4_VL_VH_S56G | GFSLTTY | 599 | RYSGD | 601 | DPMYIPNYAYG VMNA | 654 |
| CD3_sp9aFW1_VLVH | GFSLTTY | 599 | RYSGD | 601 | DPMYIPNYAYG VMNA | 654 |
| CD3_sp9aFW4_VLVH | GFSLTTY | 599 | RYSGD | 601 | DPMYIPNYAYG VMNA | 654 |
| CD3_sp9arabtor_VHVL | GFSLTTY | 599 | RYSGD | 601 | DPMYIPNYAYG VMNA | 654 |
| CD3_sp9arabtor_VLVH | GFSLTTY | 599 | RYSGD | 601 | DPMYIPNYAYG VMNA | 654 |
| CD3_sp11 a_VHVL_YY_SANSPTM | GFTFSKQ | 688 | YYDSSK | 689 | FYYDLDFDH | 647 |
| CD3_sp11 a_VHVL_YY_SANSPTM_Y | GFTFSKQ | 688 | YYDSSK | 689 | YYYDLDFDH | 655 |
| CD3_sp11 a_VHVL_YY_SANSPTM_S | GFTFSKQ | 688 | YYDSSK | 689 | SYYDLDFDH | 656 |
| CD3_sp11 a_VHVL_YY_Y | GFTFSKN | 686 | YYDSSK | 689 | YYYDLDFDH | 655 |
| CD3_sp11 a_VHVL_YY_s | GFTFSKN | 686 | YYDSSK | 689 | SYYDLDFDH | 656 |
| CD3_sp11 a_VHVL_SS_SANSPTM | GFTFSKQ | 688 | YYDSSK | 689 | FSSDLDFDH | 648 |
| CD3_sp11a_VHVL_SS_SANSPTM_Y | GFTFSKQ | 688 | YYDSSK | 689 | YSSDLDFDH | 657 |
| CD3_sp11a_VHVL_SS_SANSPTM_S | GFTFSKQ | 688 | YYDSSK | 689 | SSSDLDFDH | 658 |
| CD3_sp11 a_VHVL_SS_Y | GFTFSKN | 686 | YYDSSK | 689 | YSSDLDFDH | 657 |
| CD3_sp11 a_VHVL_SS_S | GFTFSKN | 686 | YYDSSK | 689 | SSSDLDFDH | 658 |
| CD3_sp11a_VHVL_SS_SANSPTM | GFTFSKQ | 688 | YYDSSK | 689 | FSSDLDFDH | 648 |
| CD3_sp11a_VHVL_WS_SANSPTM_Y | GFTFSKQ | 688 | YYDSSK | 689 | YWSDLDFDH | 659 |
| CD3_sp11a_VHVL_WS_SANSPTM_S | GFTFSKQ | 688 | YYDSSK | 689 | SWSDLDFDH | 660 |
| CD3_sp11a_VHVL_WS_Y | GFTFSKN | 686 | YYDSSK | 689 | YWSDLDFDH | 659 |

TABLE AE-1-continued

CD3 Binders- Heavy Chain CDR sequences according to Chothia
numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_WS_ S | GFTFSKN | 686 | YYDSSK | 689 | SWSDLDFDH | 660 |
| CD3_sp11a_VHVL_WS_ SANSPTM | GFTFSKQ | 688 | YYDSSK | 689 | FWSDLDFDH | 649 |
| CD3_sp11a_VHVL_SW_ SANSPTM_Y | GFTFSKQ | 688 | YYDSSK | 689 | YSWDLDFDH | 661 |
| CD3_sp11a_VHVL_SW_ SANSPTM_S | GFTFSKQ | 688 | YYDSSK | 689 | SSWDLDFDH | 662 |
| CD3_sp11a_VHVL_SW_ Y | GFTFSKN | 686 | YYDSSK | 689 | YSWDLDFDH | 661 |
| CD3_sp11a_VHVL_SW_ S | GFTFSKN | 686 | YYDSSK | 689 | SSWDLDFDH | 662 |
| CD3_sp11a_VHVL_SW_ SANSPTM | GFTFSKQ | 688 | YYDSSK | 689 | FSWDLDFDH | 650 |
| CD3_sp11a_VHVL_TW_ SANSPTM_Y | GFTFSKQ | 688 | YYDSSK | 689 | YTWDLDFDH | 663 |
| CD3_sp11a_VHVL_TW_ SANSPTM_S | GFTFSKQ | 688 | YYDSSK | 689 | STWDLDFDH | 664 |
| CD3_sp11a_VHVL_TW_Y | GFTFSKN | 686 | YYDSSK | 689 | YTWDLDFDH | 663 |
| CD3_sp11a_VHVL_TW_S | GFTFSKN | 686 | YYDSSK | 689 | STWDLDFDH | 664 |
| CD3_sp11a_VHVL_TW_ SANSPTM | GFTFSKQ | 688 | YYDSSK | 689 | FTWDLDFDH | 652 |
| CD3_sp11a_VHVL_TT_ SANSPTM_Y | GFTFSKQ | 688 | YYDSSK | 689 | YTTDLDFDH | 665 |
| CD3_sp11a_VHVL_TT_ SANSPTM_S | GFTFSKQ | 688 | YYDSSK | 689 | STTDLDFDH | 666 |
| CD3_sp11a_VHVL_TT_Y | GFTFSKN | 686 | YYDSSK | 689 | YTTDLDFDH | 665 |
| CD3_sp11a_VHVL_TT_S | GFTFSKN | 686 | YYDSSK | 689 | STTDLDFDH | 666 |
| CD3_sp11a_VHVL_TT_ SANSPTM | GFTFSKQ | 688 | YYDSSK | 689 | FTTDLDFDH | 651 |
| CD3_SP11AVH3_VLK_3_ Y | GFTFSKN | 686 | YYDSSK | 689 | YWWDLDFDH | 667 |
| CD3_SP11AVH3_VLK_3_ S | GFTFSKN | 686 | YYDSSK | 689 | SWWDLDFDH | 668 |
| CD3_SP11AVH3_VLK_3_ Y_PTM | GFTFSKN | 686 | YYDSSK | 689 | YWWDLDFDH | 667 |
| CD3_SP11AVH3_VLK_3_ S_PTM | GFTFSKN | 686 | YYDSSK | 689 | SWWDLDFDH | 668 |
| CD3_SP11AVH3_VLK_3_ Y_SW | GFTFSKN | 686 | YYDSSK | 689 | YSWDLDFDH | 661 |
| CD3_SP11AVH3_VLK_3_ S_SW | GFTFSKN | 686 | YYDSSK | 689 | SSWDLDFDH | 662 |
| CD3_SP11AVH3_VLK_3_ Y_PTM_SW | GFTFSKN | 686 | YYDSSK | 689 | YSWDLDFDH | 661 |
| CD3_SP11AVH3_VLK_3_ S_SWPTM | GFTFSKN | 686 | YYDSSK | 689 | SSWDLDFDH | 662 |
| CD3_SP11AVH3_VLK_ SWPTM | GFTFSKN | 686 | YYDSSK | 689 | FSWDLDFDH | 650 |

TABLE AE-1-continued

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11AVH3_VLK_3_SW | GFTFSKN | 686 | YYDSSK | 689 | FSWDLDFDH | 650 |
| CD3_sp11a_VH1_VK2_Y | GFTFSKQ | 688 | YYDSSK | 689 | YWWDLDFDH | 667 |
| CD3_sp11a_VH1_VK2_S | GFTFSKQ | 688 | YYDSSK | 689 | SWWDLDFDH | 668 |
| CD3_sp11a_VH1_VK2_Y_PTM | GFTFSKN | 686 | YYDSSK | 689 | YWWDLDFDH | 667 |
| CD3_sp11a_VH1_VK2_S_PTM | GFTFSKN | 686 | YYDSSK | 689 | SWWDLDFDH | 668 |
| CD3_sp11a_VH1_VK2_Y_SW | GFTFSKQ | 688 | YYDSSK | 689 | YSWDLDFDH | 661 |
| CD3_sp11a_VH1_VK2_S_SW | GFTFSKQ | 688 | YYDSSK | 689 | SSWDLDFDH | 662 |
| CD3_sp11a_VH1_VK2_Y_PTM | GFTFSKN | 686 | YYDSSK | 689 | YSWDLDFDH | 661 |
| CD3_sp11a_VH1_VK2_S_PTM_SW | GFTFSKN | 686 | YYDSSK | 689 | SSWDLDFDH | 662 |
| CD3_sp11a_VH1_VK2_SW | GFTFSKQ | 688 | YYDSSK | 689 | FSWDLDFDH | 650 |
| CD3_sp11a_VH1_VK2_SW_PTM | GFTFSKN | 686 | YYDSSK | 689 | FSWDLDFDH | 650 |
| CD3_SP11A_VH3_VLK1_Y | GFTFSKN | 686 | YYDSSK | 689 | YWWDLDFDH | 667 |
| CD3_SP11A_VH3_VLK1_S | GFTFSKN | 686 | YYDSSK | 689 | SWWDLDFDH | 668 |
| CD3_SP11A_VH3_VLK1_Y_PTM | GFTFSKQ | 688 | YYDSSK | 689 | YWWDLDFDH | 667 |
| CD3_SP11A_VH3_VLK1_S_PTM | GFTFSKN | 686 | YYDSSK | 689 | SWWDLDFDH | 668 |
| CD3_SP11A_VH3_VLK1_Y_SW | GFTFSKN | 686 | YYDSSK | 689 | YSWDLDFDH | 661 |
| CD3_SP11A_VH3_VLK1_S_SW | GFTFSKN | 686 | YYDSSK | 689 | SSWDLDFDH | 662 |
| CD3_SP11A_VH3_VLK1_Y_PTM | GFTFSKQ | 688 | YYDSSK | 689 | YWWDLDFDH | 667 |
| CD3_SP11A_VH3_VLK1_S_PTM_SW | GFTFSKN | 686 | YYDSSK | 689 | SSWDLDFDH | 662 |
| CD3_SP11A_VH3_VLK1_PTM_SW | GFTFSKN | 686 | YYDSSK | 689 | FSWDLDFDH | 650 |
| CD3_SP11A_VH3_VLK1_SW | GFTFSKN | 686 | YYDSSK | 689 | FSWDLDFDH | 650 |
| CD3_SP11A_VH5_VK2_Y | GFTFSKQ | 688 | YYDSSK | 689 | YWWDLDFDH | 667 |
| CD3_SP11A_VH5_VK2_S | GFTFSKQ | 688 | YYDSSK | 689 | SWWDLDFDH | 668 |
| CD3_SP11A_VH5_VK2_Y_PTM | GFTFSKN | 686 | YYDSSK | 689 | YWWDLDFDH | 667 |
| CD3_SP11A_VH5_VK2_S_PTM | GFTFSKN | 686 | YYDSSK | 689 | SWWDLDFDH | 668 |
| CD3_SP11A_VH5_VK2_Y_SW | GFTFSKQ | 688 | YYDSSK | 689 | YSWDLDFDH | 661 |

TABLE AE-1-continued

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2_S_SW | GFTFSKQ | 688 | YYDSSK | 689 | SSWDLDFDH | 662 |
| CD3_SP11A_VH5_VK2_Y_PTM_SW | GFTFSKN | 686 | YYDSSK | 689 | YSWDLDFDH | 661 |
| CD3_SP11A_VH5_VK2_S_PTM_SW | GFTFSKN | 686 | YYDSSK | 689 | SSWDLDFDH | 662 |
| CD3_SP11A_VH5_VK2_PTM_SW | GFTFSKN | 686 | YYDSSK | 689 | FSWDLDFDH | 650 |
| CD3_SP11A_VH5_VK2_SW | GFTFSKQ | 688 | YYDSSK | 689 | FSWDLDFDH | 650 |

TABLE AE-2

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| NOV292 | SQSLVRSDGTTY | 693 | RVS | 625 | SSHFPW | 703 |
| NOV123 | SQSLIYSIGNTY | 694 | RVS | 625 | STHLPY | 627 |
| Sp10b | SQSLIYSIGNTY | 694 | RVS | 625 | STHLPY | 627 |
| NOV453 | SQNINNY | 695 | NTD | 700 | HRSRY | 704 |
| NOV229 | SQNINNY | 695 | NTD | 700 | HRSRY | 704 |
| NOV110 | SQSLVYSHGNTY | 696 | RVS | 625 | STHLPY | 627 |
| NOV832 | SQSLVYSHGNTY | 696 | RVS | 625 | STHLPY | 627 |
| NOV589 | SQSLVRSDGTTY | 693 | RVS | 625 | SSHFPW | 703 |
| NOV580 | SQNIDKY | 697 | NTN | 701 | HRSSY | 705 |
| NOV567 | SQSIGNS | 698 | STS | 702 | YATYPY | 706 |
| NOV221 | SQNIDKY | 697 | NTN | 701 | HRSGY | 707 |
| CD3_sp11a_bkm1 | SQSLVRSDGTTY | 693 | RVS | 625 | SSHFPW | 703 |
| CD3_SP11a_bkm2 | SQSLVRSDGTTY | 693 | RVS | 625 | SSHFPW | 703 |
| CD3_sp11_a_hz0 | SQSLVRSDGTTY | 693 | RVS | 625 | SSHFPW | 703 |
| CD3_SP11A_HZ1 | SQSLVRSDGTTY | 693 | RVS | 625 | SSHFPW | 703 |
| CD3_sp11a_sansPTM_hz1 | SQSLVRSEGTTY | 699 | RVS | 625 | SSHFPW | 703 |
| CD3_sp11a_sansPTM_rat | SQSLVRSEGTTY | 699 | RVS | 625 | SSHFPW | 703 |
| CD3_sp11a_VHVL_YY | SQSLVRSDGTTY | 693 | RVS | 625 | SSHFPW | 703 |

TABLE AE-2-continued

CD3 Binders- Light Chain CDR sequences according to
Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VHVL_SS | SQSLVRSD GTTY | 693 | RVS | 625 | SSHFPW | 703 |
| CD3_SP11A_VHVL_WS | SQSLVRSD GTTY | 693 | RVS | 625 | SSHFPW | 703 |
| CD3_sp11a_VHVL_SW | SQSLVRSD GTTY | 693 | RVS | 625 | SSHFPW | 703 |
| CD3_SP11A_VHVL_TT | SQSLVRSD GTTY | 693 | RVS | 625 | SSHFPW | 703 |
| CD3_SP11A_VHVL_TW | SQSLVRSD GTTY | 693 | RVS | 625 | SSHFPW | 703 |
| CD3_SP11A_VHVL_WT | SQSLVRSD GTTY | 693 | RVS | 625 | SSHFPW | 703 |
| CD3_SP11A_VH3_VLK_3 | SQSLVRSE GTTY | 699 | RVS | 625 | SSHFPW | 703 |
| CD3_sp11a_VH1_VK2 | SQSLVRSD GTTY | 693 | RVS | 625 | SSHFPW | 703 |
| CD3_SP11A_VH3_VLK1 | SQSLVRSE GTTY | 699 | RVS | 625 | SSHFPW | 703 |
| CD3_SP11A_VH5_VK2 | SQSLVRSD GTTY | 693 | RVS | 625 | SSHFPW | 703 |
| CD3_sp9aFW1_VL_VH_S56G | SQNINNY | 695 | NTD | 700 | HRSRY | 704 |
| CD3_SP9AFW4_VL_VH_S56G | SQNINNY | 695 | NTD | 700 | HRSRY | 704 |
| CD3_sp9aFW1_VLVH | SQNINNY | 695 | NTD | 700 | HRSRY | 704 |
| CD3_sp9aFW4_VLVH | SQNINNY | 695 | NTD | 700 | HRSRY | 704 |
| CD3_sp9arabtor_VHVL | SQNINNY | 695 | NTD | 700 | HRSRY | 704 |
| CD3_sp9arabtor_VLVH | SQNINNY | 695 | NTD | 700 | HRSRY | 704 |
| CD3_sp11a_VHVL_YY_SANSPTM | SQSLVRSE GTTY | 699 | RVS | 625 | SSHFPW | 703 |
| CD3_sp11a_VHVL_YY_SANSPTM_Y | SQSLVRSE GTTY | 699 | RVS | 625 | SSHFPW | 703 |
| CD3_sp11a_VHVL_YY_SANSPTM_S | SQSLVRSE GTTY | 699 | RVS | 625 | SSHFPW | 703 |
| CD3_sp11a_VHVL_YY_Y | SQSLVRSD GTTY | 693 | RVS | 625 | SSHFPW | 703 |
| CD3_sp11a_VHVL_YY_s | SQSLVRSD GTTY | 693 | RVS | 625 | SSHFPW | 703 |
| CD3_sp11a_VHVL_SS_SANSPTM | SQSLVRSE GTTY | 699 | RVS | 625 | SSHFPW | 703 |
| CD3_sp11a_VHVL_SS_SANSPTM_Y | SQSLVRSE GTTY | 699 | RVS | 625 | SSHFPW | 703 |
| CD3_sp11a_VHVL_SS_SANSPTM_S | SQSLVRSE GTTY | 699 | RVS | 625 | SSHFPW | 703 |
| CD3_sp11a_VHVL_SS_Y | SQSLVRSD GTTY | 693 | RVS | 625 | SSHFPW | 703 |
| CD3_sp11a_VHVL_SS_S | SQSLVRSD GTTY | 693 | RVS | 625 | SSHFPW | 703 |

TABLE AE-2-continued

CD3 Binders- Light Chain CDR sequences according to
Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_SS_SANSPTM | SQSLVRSE GTTY | 699 | RVS | 625 | SSHFPW | 703 |
| CD3_sp11a_VHVL_WS_SANSPTM_Y | SQSLVRSE GTTY | 699 | RVS | 625 | SSHFPW | 703 |
| CD3_sp11a_VHVL_WS_SANSPTM_S | SQSLVRSE GTTY | 699 | RVS | 625 | SSHFPW | 703 |
| CD3_sp11a_VHVL_WS_Y | SQSLVRSD GTTY | 693 | RVS | 625 | SSHFPW | 703 |
| CD3_sp11a_VHVL_WS_S | SQSLVRSD GTTY | 693 | RVS | 625 | SSHFPW | 703 |
| CD3_sp11a_VHVL_WS_SANSPTM | SQSLVRSE GTTY | 699 | RVS | 625 | SSHFPW | 703 |
| CD3_sp11a_VHVL_SW_SANSPTM_Y | SQSLVRSE GTTY | 699 | RVS | 625 | SSHFPW | 703 |
| CD3_sp11a_VHVL_SW_SANSPTM_S | SQSLVRSE GTTY | 699 | RVS | 625 | SSHFPW | 703 |
| CD3_sp11a_VHVL_SW_Y | SQSLVRSD GTTY | 693 | RVS | 625 | SSHFPW | 703 |
| CD3_sp11a_VHVL_SW_S | SQSLVRSD GTTY | 693 | RVS | 625 | SSHFPW | 703 |
| CD3_sp11a_VHVL_SW_SANSPTM | SQSLVRSE GTTY | 699 | RVS | 625 | SSHFPW | 703 |
| CD3_sp11a_VHVL_TW_SANSPTM_Y | SQSLVRSE GTTY | 699 | RVS | 625 | SSHFPW | 703 |
| CD3_sp11a_VHVL_TW_SANSPTM_S | SQSLVRSE GTTY | 699 | RVS | 625 | SSHFPW | 703 |
| CD3_sp11a_VHVL_TW_Y | SQSLVRSD GTTY | 693 | RVS | 625 | SSHFPW | 703 |
| CD3_sp11a_VHVL_TW_S | SQSLVRSD GTTY | 693 | RVS | 625 | SSHFPW | 703 |
| CD3_sp11a_VHVL_TW_SANSPTM | SQSLVRSE GTTY | 699 | RVS | 625 | SSHFPW | 703 |
| CD3_sp11a_VHVL_TT_SANSPTM_Y | SQSLVRSE GTTY | 699 | RVS | 625 | SSHFPW | 703 |
| CD3_sp11a_VHVL_TT_SANSPTM_S | SQSLVRSE GTTY | 699 | RVS | 625 | SSHFPW | 703 |
| CD3_sp11a_VHVL_TT_Y | SQSLVRSD GTTY | 693 | RVS | 625 | SSHFPW | 703 |
| CD3_sp11a_VHVL_TT_S | SQSLVRSD GTTY | 693 | RVS | 625 | SSHFPW | 703 |
| CD3_sp11a_VHVL_TT_SANSPTM | SQSLVRSE GTTY | 699 | RVS | 625 | SSHFPW | 703 |
| CD3_SP11AVH3_VLK_3_Y | SQSLVRSE GTTY | 699 | RVS | 625 | SSHFPW | 703 |
| CD3_SP11AVH3_VLK_3_S | SQSLVRSE GTTY | 699 | RVS | 625 | SSHFPW | 703 |
| CD3_SP11AVH3_VLK_3_Y_PTM | SQSLVRSD GTTY | 693 | RVS | 625 | SSHFPW | 703 |
| CD3_SP11AVH3_VLK_3_S_PTM | SQSLVRSD GTTY | 693 | RVS | 625 | SSHFPW | 703 |

TABLE AE-2-continued

CD3 Binders- Light Chain CDR sequences according to
Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11AVH3_VLK_3_Y_SW | SQSLVRSE GTTY | 699 | RVS | 625 | SSHFPW | 703 |
| CD3_SP11AVH3_VLK_3_S_SW | SQSLVRSE GTTY | 699 | RVS | 625 | SSHFPW | 703 |
| CD3_SP11AVH3_VLK_3_Y_PTM_SW | SQSLVRSD GTTY | 693 | RVS | 625 | SSHFPW | 703 |
| CD3_SP11AVH3_VLK_3_S_SWPTM | SQSLVRSD GTTY | 693 | RVS | 625 | SSHFPW | 703 |
| CD3_SP11AVH3_VLK_SWPTM | SQSLVRSD GTTY | 693 | RVS | 625 | SSHFPW | 703 |
| CD3_SP11AVH3_VLK_3_SW | SQSLVRSE GTTY | 699 | RVS | 625 | SSHFPW | 703 |
| CD3_sp11a_VH1_VK2_Y | SQSLVRSD GTTY | 693 | RVS | 625 | SSHFPW | 703 |
| CD3_sp11a_VH1_VK2_S | SQSLVRSD GTTY | 693 | RVS | 625 | SSHFPW | 703 |
| CD3_sp11a_VH1_VK2_Y_PTM | SQSLVRSE GTTY | 699 | RVS | 625 | SSHFPW | 703 |
| CD3_sp11a_VH1_VK2_S_PTM | SQSLVRSD GTTY | 693 | RVS | 625 | SSHFPW | 703 |
| CD3_sp11a_VH1_VK2_Y_SW | SQSLVRSD GTTY | 693 | RVS | 625 | SSHFPW | 703 |
| CD3_sp11a_VH1_VK2_S_SW | SQSLVRSD GTTY | 693 | RVS | 625 | SSHFPW | 703 |
| CD3_sp11a_VH1_VK2_Y_PTM | SQSLVRSE GTTY | 699 | RVS | 625 | SSHFPW | 703 |
| CD3_sp11a_VH1_VK2_S_PTM_SW | SQSLVRSD GTTY | 693 | RVS | 625 | SSHFPW | 703 |
| CD3_sp11a_VH1_VK2_SW | SQSLVRSD GTTY | 693 | RVS | 625 | SSHFPW | 703 |
| CD3_sp11a_VH1_VK2_SW_PTM | SQSLVRSE GTTY | 699 | RVS | 625 | SSHFPW | 703 |
| CD3_SP11A_VH3_VLK1_Y | SQSLVRSE GTTY | 699 | RVS | 625 | SSHFPW | 703 |
| CD3_SP11A_VH3_VLK1_S | SQSLVRSE GTTY | 699 | RVS | 625 | SSHFPW | 703 |
| CD3_SP11A_VH3_VLK1_Y_PTM | SQSLVRSD GTTY | 693 | RVS | 625 | SSHFPW | 703 |
| CD3_SP11A_VH3_VLK1_S_PTM | SQSLVRSD GTTY | 693 | RVS | 625 | SSHFPW | 703 |
| CD3_SP11A_VH3_VLK1_Y_SW | SQSLVRSE GTTY | 699 | RVS | 625 | SSHFPW | 703 |
| CD3_SP11A_VH3_VLK1_S_SW | SQSLVRSE GTTY | 699 | RVS | 625 | SSHFPW | 703 |
| CD3_SP11A_VH3_VLK1_Y_PTM | SQSLVRSD GTTY | 693 | RVS | 625 | SSHFPW | 703 |
| CD3_SP11A_VH3_VLK1_S_PTM_SW | SQSLVRSD GTTY | 693 | RVS | 625 | SSHFPW | 703 |

TABLE AE-2-continued

| | | | | | | |
|---|---|---|---|---|---|---|
| CD3 Binders- Light Chain CDR sequences according to Chothia numbering scheme | | | | | | |
| Binder | CDR-L1 | SEQ ID NO: | CDR-L2 | SEQ ID NO: | CDR-L3 | SEQ ID NO: |
| CD3_SP11A_VH3_VLK1PTM_SW | SQSLVRSD GTTY | 693 | RVS | 625 | SSHFPW | 703 |
| CD3_SP11A_VH3_VLK1_SW | SQSLVRSE GTTY | 699 | RVS | 625 | SSHFPW | 703 |
| CD3_SP11A_VH5_VK2_Y | SQSLVRSD GTTY | 693 | RVS | 625 | SSHFPW | 703 |
| CD3_SP11A_VH5_VK2_S | SQSLVRSD GTTY | 693 | RVS | 625 | SSHFPW | 703 |
| CD3_SP11A_VH5_VK2_Y_PTM | SQSLVRSD GTTY | 693 | RVS | 625 | SSHFPW | 703 |
| CD3_SP11A_VH5_VK2_S_PTM | SQSLVRSD GTTY | 693 | RVS | 625 | SSHFPW | 703 |
| CD3_SP11A_VH5_VK2_Y_SW | SQSLVRSD GTTY | 693 | RVS | 625 | SSHFPW | 703 |
| CD3_SP11A_VH5_VK2_S_SW | SQSLVRSD GTTY | 693 | RVS | 625 | SSHFPW | 703 |
| CD3_SP11A_VH5_VK2_Y_PTM_SW | SQSLVRSD GTTY | 693 | RVS | 625 | SSHFPW | 703 |
| CD3_SP11A_VH5_VK2_S_PTM_SW | SQSLVRSD GTTY | 693 | RVS | 625 | SSHFPW | 703 |
| CD3_SP11A_VH5_VK2_PTM_SW | SQSLVRSD GTTY | 693 | RVS | 625 | SSHFPW | 703 |
| CD3_SP11A_VH5_VK2_SW | SQSLVRSD GTTY | 693 | RVS | 625 | SSHFPW | 703 |

TABLE AF-1

| | | | | | | |
|---|---|---|---|---|---|---|
| CD3 Binders- Heavy Chain CDR sequences according to IMGT numbering scheme | | | | | | |
| Binder | CDR-H1 | SEQ ID NO: | CDR-H2 | SEQ ID NO: | CDR-H3 | SEQ ID NO: |
| NOV292 | GFTFSKN G | 708 | IYYDSSKM | 711 | ASFWWDLDF DH | 715 |
| NOV123 | GYTFTSY Y | 614 | IYPGHDAI | 712 | VRPNTMMAP LAY | 716 |
| Sp10b | GYTFTSY Y | 614 | IYPGHDAI | 712 | VRPNTMMAP LAY | 716 |
| NOV453 | GFSLTTY N | 597 | MRYSGDT | 602 | TSDPMYIPN YSYGVMNA | 717 |
| NOV229 | GFSLTTY N | 597 | MRYSGDT | 602 | ARDPMYIPN YSYGVMNA | 718 |
| NOV110 | GYTFTSY Y | 614 | IYPANGGI | 713 | ARPVTMMAP LVF | 719 |
| NOV832 | GYTFTSY Y | 614 | IYPANGGI | 713 | ARPVTMMAP LVF | 719 |
| NOV589 | GFTFSKN G | 708 | IYYDSSRM | 714 | ASFWWDLDF DY | 720 |
| NOV580 | GFSLTTY N | 597 | MRYSGDT | 602 | TRDPMYIPG YSYGVMNA | 721 |

TABLE AF-1-continued

| | | CD3 Binders- Heavy Chain CDR sequences according to IMGT numbering scheme | | | | |
|---|---|---|---|---|---|---|
| Binder | CDR-H1 | SEQ ID NO: | CDR-H2 | SEQ ID NO: | CDR-H3 | SEQ ID NO: |
| NOV567 | GFAFRKY G | 709 | IYYDSSKM | 711 | AALNSEYD | 582 |
| NOV221 | GFSLTTY N | 597 | MRYSGDT | 602 | TRDPMYIPG YSYGVMNA | 721 |
| CD3_sp11a_bkm1 | GFTFSKN G | 708 | IYYDSSKM | 711 | ASFWWDLDF DH | 715 |
| CD3_SP11a_bkm2 | GFTFSKN G | 708 | IYYDSSKM | 711 | AKFWWDLDF DH | 722 |
| CD3_sp11a_hz0 | GFTFSKN G | 708 | IYYDSSKM | 711 | AKFWWDLDF DH | 722 |
| CD3_SP11A_HZ1 | GFTFSKN G | 708 | IYYDSSKM | 711 | ASFWWDLDF DH | 715 |
| CD3_sp11a_sansPTM_hz1 | GFTFSKQ G | 710 | IYYDSSKM | 711 | ASFWWDLDF DH | 715 |
| CD3_sp11a_sansPTM_rat | GFTFSKQ G | 710 | IYYDSSKM | 711 | ASFWWDLDF DH | 715 |
| CD3_sp11a_VHVL_YY | GFTFSKN G | 708 | IYYDSSKM | 711 | ASFYYDLDF DH | 723 |
| CD3_SP11A_VHVL_SS | GFTFSKN G | 708 | IYYDSSKM | 711 | ASFSSDLDF DH | 724 |
| CD3_SP11A_VHVL_WS | GFTFSKN G | 708 | IYYDSSKM | 711 | ASFWSDLDF DH | 725 |
| CD3_sp11a_VHVL_SW | GFTFSKN G | 708 | IYYDSSKM | 711 | ASFSWDLDF DH | 726 |
| CD3_SP11A_VHVL_TT | GFTFSKN G | 708 | IYYDSSKM | 711 | ASFTTDLDF DH | 727 |
| CD3_SP11A_VHVL_TW | GFTFSKN G | 708 | IYYDSSKM | 711 | ASFTWDLDF DH | 728 |
| CD3_SP11A_VHVL_WT | GFTFSKN G | 708 | IYYDSSKM | 711 | ASFWTDLDF DH | 729 |
| CD3_SP11A_VH3_VLK_3 | GFTFSKN G | 708 | IYYDSSKM | 711 | ASFWWDLDF DH | 715 |
| CD3_sp11a_VH1_VK2 | GFTFSKQ G | 710 | IYYDSSKM | 711 | ASFWWDLDF DH | 715 |
| CD3_SP11A_VH3_VLK1 | GFTFSKN G | 708 | IYYDSSKM | 711 | ASFWWDLDF DH | 715 |
| CD3_SP11A_VH5_VK2 | GFTFSKQ G | 710 | IYYDSSKM | 711 | ASFWWDLDF DH | 715 |
| CD3_sp9aFW1_VL_VH_S56G | GFSLTTY N | 597 | MRYSGDT | 602 | ASDPMYIPN YAYGVMNA | 730 |
| CD3_SP9AFW4_VL_VH_S56G | GFSLTTY N | 597 | MRYSGDT | 602 | ASDPMYIPN YAYGVMNA | 730 |
| CD3_sp9aFW1_VLVH | GFSLTTY N | 597 | MRYSGDT | 602 | ASDPMYIPN YAYGVMNA | 730 |
| CD3_sp9aFW4_VLVH | GFSLTTY N | 597 | MRYSGDT | 602 | ASDPMYIPN YAYGVMNA | 730 |
| CD3_sp9arabtor_VHVL | GFSLTTY N | 597 | MRYSGDT | 602 | ASDPMYIPN YAYGVMNA | 730 |
| CD3_sp9arabtor_VLVH | GFSLTTY N | 597 | MRYSGDT | 602 | ASDPMYIPN YAYGVMNA | 730 |

TABLE AF-1-continued

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_YY_SANSPTM | GFTFSKQG | 710 | IYYDSSKM | 711 | ASFYYDLDFDH | 723 |
| CD3_sp11a_VHVL_YY_SANSPTM_Y | GFTFSKQG | 710 | IYYDSSKM | 711 | ASYYYDLDFDH | 731 |
| CD3_sp11a_VHVL_YY_SANSPTM_S | GFTFSKQG | 710 | IYYDSSKM | 711 | ASSYYDLDFDH | 732 |
| CD3_sp11a_VHVL_YY_Y | GFTFSKNG | 708 | IYYDSSKM | 711 | ASYYYDLDFDH | 731 |
| CD3_sp11a_VHVL_YY_s | GFTFSKNG | 708 | IYYDSSKM | 711 | ASSYYDLDFDH | 732 |
| CD3_sp11a_VHVL_SS_SANSPTM | GFTFSKQG | 710 | IYYDSSKM | 711 | ASFSSDLDFDH | 724 |
| CD3_sp11a_VHVL_SS_SANSPTM_Y | GFTFSKQG | 710 | IYYDSSKM | 711 | ASYSSDLDFDH | 733 |
| CD3_sp11a_VHVL_SS_SANSPTM_S | GFTFSKQG | 710 | IYYDSSKM | 711 | ASSSSDLDFDH | 734 |
| CD3_sp11a_VHVL_SS_Y | GFTFSKNG | 708 | IYYDSSKM | 711 | ASYSSDLDFDH | 733 |
| CD3_sp11a_VHVL_SS_S | GFTFSKNG | 708 | IYYDSSKM | 711 | ASSSSDLDFDH | 734 |
| CD3_sp11a_VHVL_SS_SANSPTM | GFTFSKQG | 710 | IYYDSSKM | 711 | ASFSSDLDFDH | 724 |
| CD3_sp11a_VHVL_WS_SANSPTM_Y | GFTFSKQG | 710 | IYYDSSKM | 711 | ASYWSDLDFDH | 735 |
| CD3_sp11a_VHVL_WS_SANSPTM_S | GFTFSKQG | 710 | IYYDSSKM | 711 | ASSWSDLDFDH | 736 |
| CD3_sp11a_VHVL_WS_Y | GFTFSKNG | 708 | IYYDSSKM | 711 | ASYWSDLDFDH | 735 |
| CD3_sp11a_VHVL_WS_S | GFTFSKNG | 708 | IYYDSSKM | 711 | ASSWSDLDFDH | 736 |
| CD3_sp11a_VHVL_WS_SANSPTM | GFTFSKQG | 710 | IYYDSSKM | 711 | ASFWSDLDFDH | 725 |
| CD3_sp11a_VHVL_SW_SANSPTM_Y | GFTFSKQG | 710 | IYYDSSKM | 711 | ASYSWDLDFDH | 737 |
| CD3_sp11a_VHVL_SW_SANSPTM_S | GFTFSKQG | 710 | IYYDSSKM | 711 | ASSSWDLDFDH | 738 |
| CD3_sp11a_VHVL_SW_Y | GFTFSKNG | 708 | IYYDSSKM | 711 | ASYSWDLDFDH | 737 |
| CD3_sp11a_VHVL_SW_S | GFTFSKNG | 708 | IYYDSSKM | 711 | ASSSWDLDFDH | 738 |
| CD3_sp11a_VHVL_SW_SANSPTM | GFTFSKQG | 710 | IYYDSSKM | 711 | ASFSWDLDFDH | 726 |
| CD3_sp11a_VHVL_TW_SANSPTM_Y | GFTFSKQG | 710 | IYYDSSKM | 711 | ASYTWDLDFDH | 739 |
| CD3_sp11a_VHVL_TW_SANSPTM_S | GFTFSKQG | 710 | IYYDSSKM | 711 | ASSTWDLDFDH | 740 |
| CD3_sp11a_VHVL_TW_Y | GFTFSKNG | 708 | IYYDSSKM | 711 | ASYTWDLDFDH | 739 |

TABLE AF-1-continued

CD3 Binders- Heavy Chain CDR sequences according to
IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_TW_S | GFTFSKNG | 708 | IYYDSSKM | 711 | ASSTWDLDFDH | 740 |
| CD3_sp11a_VHVL_TW_SANSPTM | GFTFSKQG | 710 | IYYDSSKM | 711 | ASFTWDLDFDH | 728 |
| CD3_sp11a_VHVL_TT_SANSPTM_Y | GFTFSKQG | 710 | IYYDSSKM | 711 | ASYTTDLDFDH | 741 |
| CD3_sp11a_VHVL_TT_SANSPTM_S | GFTFSKQG | 710 | IYYDSSKM | 711 | ASSTTDLDFDH | 742 |
| CD3_sp11a_VHVL_TT_Y | GFTFSKNG | 708 | IYYDSSKM | 711 | ASYTTDLDFDH | 741 |
| CD3_sp11a_VHVL_TT_S | GFTFSKNG | 708 | IYYDSSKM | 711 | ASSTTDLDFDH | 742 |
| CD3_sp11a_VHVL_TT_SANSPTM | GFTFSKQG | 710 | IYYDSSKM | 711 | ASFTTDLDFDH | 727 |
| CD3_SP11AVH3_VLK_3_Y | GFTFSKNG | 708 | IYYDSSKM | 711 | ASYWWDLDFDH | 743 |
| CD3_SP11AVH3_VLK_3_S | GFTFSKNG | 708 | IYYDSSKM | 711 | ASSWWDLDFDH | 744 |
| CD3_SP11AVH3_VLK_3_Y_PTM | GFTFSKNG | 708 | IYYDSSKM | 711 | ASYWWDLDFDH | 743 |
| CD3_SP11AVH3_VLK_3_S_PTM | GFTFSKNG | 708 | IYYDSSKM | 711 | ASSWWDLDFDH | 744 |
| CD3_SP11AVH3_VLK_3_Y_SW | GFTFSKNG | 708 | IYYDSSKM | 711 | ASYSWDLDFDH | 737 |
| CD3_SP11AVH3_VLK_3_S_SW | GFTFSKNG | 708 | IYYDSSKM | 711 | ASSSWDLDFDH | 738 |
| CD3_SP11AVH3_VLK_3_Y_PTM_SW | GFTFSKNG | 708 | IYYDSSKM | 711 | ASYSWDLDFDH | 737 |
| CD3_SP11AVH3_VLK_3_S_SWPTM | GFTFSKNG | 708 | IYYDSSKM | 711 | ASSSWDLDFDH | 738 |
| CD3_SP11AVH3_VLK_SWPTM | GFTFSKNG | 708 | IYYDSSKM | 711 | ASFSWDLDFDH | 726 |
| CD3_SP11AVH3_VLK_3_SW | GFTFSKNG | 708 | IYYDSSKM | 711 | ASFSWDLDFDH | 726 |
| CD3_sp11a_VH1_VK2_Y | GFTFSKQG | 710 | IYYDSSKM | 711 | ASYWWDLDFDH | 743 |
| CD3_sp11a_VH1_VK2_S | GFTFSKQG | 710 | IYYDSSKM | 711 | ASSWWDLDFDH | 744 |
| CD3_sp11a_VH1_VK2_Y_PTM | GFTFSKNG | 708 | IYYDSSKM | 711 | ASYWWDLDFDH | 743 |
| CD3_sp11a_VH1_VK2_S_PTM | GFTFSKNG | 708 | IYYDSSKM | 711 | ASSWWDLDFDH | 744 |
| CD3_sp11a_VH1_VK2_Y_SW | GFTFSKQG | 710 | IYYDSSKM | 711 | ASYSWDLDFDH | 737 |
| CD3_sp11a_VH1_VK2_S_SW | GFTFSKQG | 710 | IYYDSSKM | 711 | ASSSWDLDFDH | 738 |
| CD3_sp11a_VH1_VK2_Y_PTM | GFTFSKNG | 708 | IYYDSSKM | 711 | ASYSWDLDFDH | 737 |

TABLE AF-1-continued

CD3 Binders- Heavy Chain CDR sequences according to
IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VH1_VK2_S_PTM_SW | GFTFSKN G | 708 | IYYDSSKM | 711 | ASSSWDLDF DH | 738 |
| CD3_sp11a_VH1_VK2_SW | GFTFSKQ G | 710 | IYYDSSKM | 711 | ASFSWDLDF DH | 726 |
| CD3_sp11a_VH1_VK2_SW_PTM | GFTFSKN G | 708 | IYYDSSKM | 711 | ASFSWDLDF DH | 726 |
| CD3_SP11A_VH3_VLK1_Y | GFTFSKN G | 708 | IYYDSSKM | 711 | ASYWWDLDF DH | 743 |
| CD3_SP11A_VH3_VLK1_S | GFTFSKN G | 708 | IYYDSSKM | 711 | ASSWWDLDF DH | 744 |
| CD3_SP11A_VH3_VLK1_Y_PTM | GFTFSKQ G | 710 | IYYDSSKM | 711 | ASYWWDLDF DH | 743 |
| CD3_SP11A_VH3_VLK1_S_PTM | GFTFSKQ G | 710 | IYYDSSKM | 711 | ASSWWDLDF DH | 744 |
| CD3_SP11A_VH3_VLK1_Y_SW | GFTFSKN G | 708 | IYYDSSKM | 711 | ASYSWDLDF DH | 737 |
| CD3_SP11A_VH3_VLK1_S_SW | GFTFSKN G | 708 | IYYDSSKM | 711 | ASSSWDLDF DH | 738 |
| CD3_SP11A_VH3_VLK1_Y_PTM | GFTFSKQ G | 710 | IYYDSSKM | 711 | ASYWWDLDF DH | 743 |
| CD3_SP11A_VH3_VLK1_S_PTM_SW | GFTFSKQ G | 710 | IYYDSSKM | 711 | ASSSWDLDF DH | 738 |
| CD3_SP11A_VH3_VLK1PTM_SW | GFTFSKQ G | 710 | IYYDSSKM | 711 | ASFSWDLDF DH | 726 |
| CD3_SP11A_VH3_VLK1_SW | GFTFSKN G | 708 | IYYDSSKM | 711 | ASFSWDLDF DH | 726 |
| CD3_SP11A_VH5_VK2_Y | GFTFSKQ G | 710 | IYYDSSKM | 711 | ASYWWDLDF DH | 743 |
| CD3_SP11A_VH5_VK2_S | GFTFSKQ G | 710 | IYYDSSKM | 711 | ASSWWDLDF DH | 744 |
| CD3_SP11A_VH5_VK2_Y_PTM | GFTFSKN G | 708 | IYYDSSKM | 711 | ASYWWDLDF DH | 743 |
| CD3_SP11A_VH5_VK2_S_PTM | GFTFSKN G | 708 | IYYDSSKM | 711 | ASSWWDLDF DH | 744 |
| CD3_SP11A_VH5_VK2_Y_SW | GFTFSKQ G | 710 | IYYDSSKM | 711 | ASYSWDLDF DH | 737 |
| CD3_SP11A_VH5_VK2_S_SW | GFTFSKQ G | 710 | IYYDSSKM | 711 | ASSSWDLDF DH | 738 |
| CD3_SP11A_VH5_VK2_Y_PTM_SW | GFTFSKN G | 708 | IYYDSSKM | 711 | ASYSWDLDF DH | 737 |
| CD3_SP11A_VH5_VK2_S_PTM_SW | GFTFSKN G | 708 | IYYDSSKM | 711 | ASSSWDLDF DH | 738 |
| CD3_SP11A_VH5_VK2_PTM_SW | GFTFSKN G | 708 | IYYDSSKM | 711 | ASFSWDLDF DH | 726 |
| CD3_SP11A_VH5_VK2_SW | GFTFSKQ G | 710 | IYYDSSKM | 711 | ASFSWDLDF DH | 726 |

TABLE AF-2

| Binder | CDR-L1 | SEQ ID NO: | CDR-L2 | SEQ ID NO: | CDR-L3 | SEQ ID NO: |
|---|---|---|---|---|---|---|
| NOV292 | QSLVRSD GTTY | 745 | RVS | 625 | LQSSHF PWT | 680 |
| NOV123 | QSLIYSI GNTY | 746 | RVS | 625 | FQSTHL PYT | 626 |
| Sp10b | QSLIYSI GNTY | 746 | RVS | 625 | FQSTHL PYT | 626 |
| NOV453 | QNINNY | 747 | NTDHLQA GVP | 753 | LQHRSR YT | 681 |
| NOV229 | QNINNY | 747 | NTDHLQA GVP | 753 | LQHRSR YT | 681 |
| NOV110 | QSLVYSH GNTY | 748 | RVS | 625 | FQSTHL PYT | 626 |
| NOV832 | QSLVYSH GNTY | 748 | RVS | 625 | FQSTHL PYT | 626 |
| NOV589 | QSLVRSD GTTY | 745 | RVS | 625 | LQSSHF PWT | 680 |
| NOV580 | QNIDKY | 749 | NTNNLEA GVP | 754 | LQHRSS YT | 682 |
| NOV567 | QSIGNS | 750 | STSTLEY GVP | 755 | LQYATY PYT | 683 |
| NOV221 | QNIDKY | 749 | NTNNLEA GVP | 754 | LQHRSG YT | 684 |
| CD3_sp11a_bkm1 | QSLVRSD GTTY | 745 | RVS | 625 | LQSSHF PWT | 680 |
| CD3_SP11a_bkm2 | QSLVRSD GTTY | 745 | RVS | 625 | LQSSHF PWT | 680 |
| CD3_sp11a_hz0 | QSLVRSD GTTY | 745 | RVS | 625 | LQSSHF PWT | 680 |
| CD3_SP11A_HZ1 | QSLVRSD GTTY | 745 | RVS | 625 | LQSSH | 685 |
| CD3_sp11a_sansPTM_hz1 | QSLVRSE GTTY | 751 | RVS | 625 | LQSSHF PWT | 680 |
| CD3_sp11a_sansPTM_rat | QSLVRSE GTTY | 751 | RVS | 625 | LQSSHF PWT | 680 |
| CD3_sp11a_VHVL_YY | QSLVRSD GTTY | 745 | RVS | 625 | LQSSHF PWT | 680 |
| CD3_SP11A_VHVL_SS | QSLVRSD GTTY | 745 | RVS | 625 | LQSSHF PWT | 680 |
| CD3_SP11A_VHVL_WS | QSLVRSD GTTY | 745 | RVS | 625 | LQSSHF PWT | 680 |
| CD3_sp11a_VHVL_SW | QSLVRSD GTTY | 745 | RVS | 625 | LQSSHF PWT | 680 |
| CD3_SP11A_VHVL_TT | QSLVRSD GTTY | 745 | RVS | 625 | LQSSHF PWT | 680 |
| CD3_SP11A_VHVL_TW | QSLVRSD GTTY | 745 | RVS | 625 | LQSSHF PWT | 680 |
| CD3_SP11A_VHVL_WT | QSLVRSD GTTY | 745 | RVS | 625 | LQSSHF PWT | 680 |
| CD3_SP11A VH3_VLK_3 | QSLVRSE GTTY | 751 | RVS | 625 | LQSSHF PWT | 680 |

TABLE AF-2-continued

CD3 Binders- Light Chain CDR sequences according to
IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2 | QSLVRSD GTTY | 745 | RVS | 625 | LQSSHF PWT | 680 |
| CD3_SP11A_VH3_VLK1 | QSLVRSE GTTY | 751 | RVS | 625 | LQSSHF PWT | 680 |
| CD3_SP11A_VH5_VK2 | QSLVRSD GTTY | 745 | RVS | 625 | LQSSHF PWT | 680 |
| CD3_sp9aFW1_VL_VH_S56G | QNINNY | 747 | NTDHLQA GVP | 753 | LQHRSR YT | 681 |
| CD3_SP9AFW4_VL_VH_S56G | QNINNY | 747 | NTDHLQA GVP | 753 | LQHRSR YT | 681 |
| CD3_sp9aFW1_VLVH | QNINNY | 747 | NTDHLQA GVP | 753 | LQHRSR YT | 681 |
| CD3_sp9aFW4_VLVH | QNINNY | 747 | NTDHLQA GVP | 753 | LQHRSR YT | 681 |
| CD3_sp9arabtor_VHVL | QNINNY | 747 | NTDHLQA GVP | 753 | LQHRSR YT | 681 |
| CD3_sp9arabtor_VLVH | QNINNY | 747 | NTDHLQA GVP | 753 | LQHRSR YT | 681 |
| CD3_sp11a_VHVL_YY_SANSPTM | QSLVRSE GTTY | 751 | RVS | 625 | LQSSHF PWT | 680 |
| CD3_sp11a_VHVL_YY_SANSPTM_Y | QSLVRSE GTTY | 751 | RVS | 625 | LQSSHF PWT | 680 |
| CD3_sp11a_VHVL_YY_SANSPTM_S | QSLVRSE GTTY | 751 | RVS | 625 | LQSSHF PWT | 680 |
| CD3_sp11a_VHVL_YY_Y | QSLVRSD GTTY | 745 | RVS | 625 | LQSSHF PWT | 680 |
| CD3_sp11a_VHVL_YY_s | QSLVRSD GTTY | 745 | RVS | 625 | LQSSHF PWT | 680 |
| CD3_sp11a_VHVL_SS_SANSPTM | QSLVRSE GTTY | 751 | RVS | 625 | LQSSHF PWT | 680 |
| CD3_sp11a_VHVL_SS_SANSPTM_Y | QSLVRSE GTTY | 751 | RVS | 625 | LQSSHF PWT | 680 |
| CD3_sp11a_VHVL_SS_SANSPTM_S | QSLVRSE GTTY | 751 | RVS | 625 | LQSSHF PWT | 680 |
| CD3_sp11a_VHVL_SS_Y | QSLVRSD GTTY | 745 | RVS | 625 | LQSSHF PWT | 680 |
| CD3_sp11a_VHVL_SS_S | QSLVRSD GTTY | 745 | RVS | 625 | LQSSHF PWT | 680 |
| CD3_sp11a_VHVL_SS_SANSPTM | QSLVRSE GTTY | 751 | RVS | 625 | LQSSHF PWT | 680 |
| CD3_sp11a_VHVL_WS_SANSPTM_Y | QSLVRSE GTTY | 751 | RVS | 625 | LQSSHF PWT | 680 |
| CD3_sp11a_VHVL_WS_SANSPTM_S | QSLVRSE GTTY | 751 | RVS | 625 | LQSSHF PWT | 680 |
| CD3_sp11a_VHVL_WS_Y | QSLVRSD GTTY | 745 | RVS | 625 | LQSSHF PWT | 680 |
| CD3_sp11a_VHVL_WS_S | QSLVRSD GTTY | 745 | RVS | 625 | LQSSHF PWT | 680 |

TABLE AF-2-continued

CD3 Binders- Light Chain CDR sequences according to
IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_WS_SANSPTM | QSLVRSE GTTY | 751 | RVS | 625 | LQSSHF PWT | 680 |
| CD3_sp11a_VHVL_SW_SANSPTM_Y | QSLVRSE GTTY | 751 | RVS | 625 | LQSSHF PWT | 680 |
| CD3_sp11a_VHVL_SW_SANSPTM_S | QSLVRSE GTTY | 751 | RVS | 625 | LQSSHF PWT | 680 |
| CD3_sp11a_VHVL_SW_Y | QSLVRSD GTTY | 745 | RVS | 625 | LQSSHF PWT | 680 |
| CD3_sp11a_VHVL_SW_S | QSLVRSD GTTY | 745 | RVS | 625 | LQSSHF PWT | 680 |
| CD3_sp11a_VHVL_SW_SANSPTM | QSLVRSE GTTY | 751 | RVS | 625 | LQSSHF PWT | 680 |
| CD3_sp11a_VHVL_TW_SANSPTM_Y | QSLVRSE GTTY | 751 | RVS | 625 | LQSSHF PWT | 680 |
| CD3_sp11a_VHVL_TW_SANSPTM_S | QSLVRSE GTTY | 751 | RVS | 625 | LQSSHF PWT | 680 |
| CD3_sp11a_VHVL_TW_Y | QSLVRSD GTTY | 745 | RVS | 625 | LQSSHF PWT | 680 |
| CD3_sp11a_VHVL_TW_S | QSLVRSD GTTY | 745 | RVS | 625 | LQSSHF PWT | 680 |
| CD3_sp11a_VHVL_TW_SANSPTM | QSLVRSE GTTY | 751 | RVS | 625 | LQSSHF PWT | 680 |
| CD3_sp11a_VHVL_TT_SANSPTM_Y | QSLVRSE GTTY | 751 | RVS | 625 | LQSSHF PWT | 680 |
| CD3_sp11a_VHVL_TT_SANSPTM_S | QSLVRSE GTTY | 751 | RVS | 625 | LQSSHF PWT | 680 |
| CD3_sp11a_VHVL_TT_Y | QSLVRSD GTTY | 745 | RVS | 625 | LQSSHF PWT | 680 |
| CD3_sp11a_VHVL_TT_S | QSLVRSD GTTY | 745 | RVS | 625 | LQSSHF PWT | 680 |
| CD3_sp11a_VHVL_TT_SANSPTM | QSLVRSE GTTY | 751 | RVS | 625 | LQSSHF PWT | 680 |
| CD3_SP11AVH3_VLK_3_Y | QSLVRSE GTTY | 751 | RVS | 625 | LQSSHF PWT | 680 |
| CD3_SP11AVH3_VLK_3_S | QSLVRSE GTTY | 751 | RVS | 625 | LQSSHF PWT | 680 |
| CD3_SP11AVH3_VLK_3_Y_PTM | QSLVRSD GTTY | 745 | RVS | 625 | LQSSHF PWT | 680 |
| CD3_SP11AVH3_VLK_3_S_PTM | QSLVRSD GTTY | 745 | RVS | 625 | LQSSHF PWT | 680 |
| CD3_SP11AVH3_VLK_3_Y_SW | QSLVRSE GTTY | 751 | RVS | 625 | LQSSHF PWT | 680 |
| CD3_SP11AVH3_VLK_3_S_SW | QSLVRSE GTTY | 751 | RVS | 625 | LQSSHF PWT | 680 |
| CD3_SP11AVH3_VLK_3_Y_PTM_SW | QSLVRSD GTTY | 745 | RVS | 625 | LQSSHF PWT | 680 |
| CD3_SP11AVH3_VLK_3_S_SWPTM | QSLVRSD GTTY | 745 | RVS | 625 | LQSSHF PWT | 680 |
| CD3_SP11AVH3_VLK_SWPTM | QSLVRSD GTTY | 745 | RVS | 625 | LQSSHF PWT | 680 |

TABLE AF-2-continued

CD3 Binders- Light Chain CDR sequences according to
IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11AVH3_VLK_3_SW | QSLVRSE GTTY | 751 | RVS | 625 | LQSSHF PWT | 680 |
| CD3_sp11a_VH1_VK2_Y | QSLVRSD GTTY | 745 | RVS | 625 | LQSSHF PWT | 680 |
| CD3_sp11a_VH1_VK2_S | QSLVRSD GTTY | 745 | RVS | 625 | LQSSHF PWT | 680 |
| CD3_sp11a_VH1_VK2_Y_PTM | QSLVRSE GTTY | 751 | RVS | 625 | LQSSHF PWT | 680 |
| CD3_sp11a_VH1_VK2_S_PTM | QSLVRSE GTTY | 751 | RVS | 625 | LQSSHF PWT | 680 |
| CD3_sp11a_VH1_VK2_Y_SW | QSLVRSD GTTY | 745 | RVS | 625 | LQSSHF PWT | 680 |
| CD3_sp11a_VH1_VK2_S_SW | QSLVRSD GTTY | 745 | RVS | 625 | LQSSHF PWT | 680 |
| CD3_sp11a_VH1_VK2_Y_PTM | QSLVRSE GTTY | 751 | RVS | 625 | LQSSHF PWT | 680 |
| CD3_sp11a_VH1_VK2_S_PTM_SW | QSLVRSE GTTY | 751 | RVS | 625 | LQSSHF PWT | 680 |
| CD3_sp11a_VH1_VK2_SW | QSLVRSD GTTY | 745 | RVS | 625 | LQSSHF PWT | 680 |
| CD3_sp11a_VH1_VK2_SW_PTM | QSLVRSD ETTY | 752 | RVS | 625 | LQSSHF PWT | 680 |
| CD3_SP11A_VH3_VLK1_Y | QSLVRSE GTTY | 751 | RVS | 625 | LQSSHF PWT | 680 |
| CD3_SP11A_VH3_VLK1_S | QSLVRSE GTTY | 751 | RVS | 625 | LQSSHF PWT | 680 |
| CD3_SP11A_VH3_VLK1_Y_PTM | QSLVRSD GTTY | 745 | RVS | 625 | LQSSHF PWT | 680 |
| CD3_SP11A_VH3_VLK1_S_PTM | QSLVRSD GTTY | 745 | RVS | 625 | LQSSHF PWT | 680 |
| CD3_SP11A_VH3_VLK1_Y_SW | QSLVRSE GTTY | 751 | RVS | 625 | LQSSHF PWT | 680 |
| CD3_SP11A_VH3_VLK1_S_SW | QSLVRSE GTTY | 751 | RVS | 625 | LQSSHF PWT | 680 |
| CD3_SP11A_VH3_VLK1_Y_PTM | QSLVRSD GTTY | 745 | RVS | 625 | LQSSHF PWT | 680 |
| CD3_SP11A_VH3_VLK1_S_PTM_SW | QSLVRSD GTTY | 745 | RVS | 625 | LQSSHF PWT | 680 |
| CD3_SP11A_VH3_VLK1PTM_SW | QSLVRSD GTTY | 745 | RVS | 625 | LQSSHF PWT | 680 |
| CD3_SP11A_VH3_VLK1_SW | QSLVRSE GTTY | 751 | RVS | 625 | LQSSHF PWT | 680 |
| CD3_SP11A_VH5_VK2_Y | QSLVRSD GTTY | 745 | RVS | 625 | LQSSHF PWT | 680 |
| CD3_SP11A_VH5_VK2_S | QSLVRSD GTTY | 745 | RVS | 625 | LQSSHF PWT | 680 |
| CD3_SP11A_VH5_VK2_Y_PTM | QSLVRSD GTTY | 745 | RVS | 625 | LQSSHF PWT | 680 |

TABLE AF-2-continued

| CD3 Binders- Light Chain CDR sequences according to IMGT numbering scheme | | | | | | |
|---|---|---|---|---|---|---|
| Binder | CDR-L1 | SEQ ID NO: | CDR-L2 | SEQ ID NO: | CDR-L3 | SEQ ID NO: |
| CD3_SP11A_VH5_VK2_S_PTM | QSLVRSD GTTY | 745 | RVS | 625 | LQSSHF PWT | 680 |
| CD3_SP11A_VH5_VK2_Y_SW | QSLVRSD GTTY | 745 | RVS | 625 | LQSSHF PWT | 680 |
| CD3_SP11A_VH5_VK2_S_SW | QSLVRSD GTTY | 745 | RVS | 625 | LQSSHF PWT | 680 |
| CD3_SP11A_VH5_VK2_Y_PTM_SW | QSLVRSD GTTY | 745 | RVS | 625 | LQSSHF PWT | 680 |
| CD3_SP11A_VH5_VK2_S_PTM_SW | QSLVRSD GTTY | 745 | RVS | 625 | LQSSHF PWT | 680 |
| CD3_SP11A_VH5_VK2_PTM_SW | QSLVRSD GTTY | 745 | RVS | 625 | LQSSHF PWT | 680 |
| CD3_SP11A_VH5_VK2_SW | QSLVRSD GTTY | 745 | RVS | 625 | LQSSHF PWT | 680 |

TABLE AG-1

| CD3 Binders- Heavy Chain CDR sequences according to combination of Kabat and Chothia numbering schemes | | | | | | |
|---|---|---|---|---|---|---|
| Binder | CDR-H1 | SEQ ID NO: | CDR-H2 | SEQ ID NO: | CDR-H3 | SEQ ID NO: |
| NOV292 | GFTFSK NGMH | 756 | MIYYDSSKMY YADTVKG | 634 | FWWDLDFDH | 641 |
| NOV123 | GYTFTS YYIY | 613 | YIYPGHDAIY YSENFKG | 635 | PNTMMAPLA Y | 642 |
| Sp10b | GYTFTS YYIY | 613 | YIYPGHDAIY YSENFKG | 635 | PNTMMAPLA Y | 642 |
| NOV453 | GFSLTT YNVH | 757 | RMRYSGDTSF NAALTS | 636 | DPMYIPNYS YGVMNA | 643 |
| NOV229 | GFSLTT YNVH | 757 | RMRYSGDTSF NAALTS | 636 | DPMYIPNYS YGVMNA | 643 |
| NOV110 | GYTFTS YYIY | 613 | YIYPANGGIY YSEKFKG | 637 | PVTMMAPLV F | 644 |
| NOV832 | GYTFTS YYIY | 613 | YIYPANGGIY YSEKFKG | 637 | PVTMMAPLV F | 644 |
| NOV589 | GFTFSK NGMH | 756 | MIYYDSSRMY YADTVKG | 638 | FWWDLDFDY | 645 |
| NOV580 | GFSLTT YNIH | 758 | RMRYSGDTSY SSALKS | 639 | DPMYIPGYS YGVMNA | 646 |
| NOV567 | GFAFRK YGMS | 759 | LIYYDSSKMN YADTVKG | 640 | LNSEYD | 583 |
| NOV221 | GFSLTT YNIH | 758 | RMRYSGDTSY SSALKS | 639 | DPMYIPGYS YGVMNA | 646 |
| CD3_sp11a_bkm1 | GFTFSK NGMH | 756 | MIYYDSSKMY YADTVKG | 634 | FWWDLDFDH | 641 |
| CD3_SP11a_bkm2 | GFTFSK NGMH | 756 | MIYYDSSKMY YADTVKG | 634 | FWWDLDFDH | 641 |
| CD3_sp11a_hz0 | GFTFSK NGMH | 756 | MIYYDSSKMY YADTVKG | 634 | FWWDLDFDH | 641 |

TABLE AG-1-continued

CD3 Binders- Heavy Chain CDR sequences according to combination
of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_HZ1 | GFTFSK NGMH | 756 | MIYYDSSKMY YADTVKG | 634 | FWWDLDFDH | 641 |
| CD3_sp11a_sansPTM_hz1 | GFTFSK QGMH | 760 | MIYYDSSKMY YADTVKG | 634 | FWWDLDFDH | 641 |
| CD3_sp11a_sansPTM_rat | GFTFSK QGMH | 760 | MIYYDSSKMY YADTVKG | 634 | FWWDLDFDH | 641 |
| CD3_sp11a_VHVL_YY | GFTFSK NGMH | 756 | MIYYDSSKMY YADTVKG | 634 | FYYDLDFDH | 647 |
| CD3_SP11A_VHVL_SS | GFTFSK NGMH | 756 | MIYYDSSKMY YADTVKG | 634 | FSSDLDFDH | 648 |
| CD3_SP11A_VHVL_WS | GFTFSK NGMH | 756 | MIYYDSSKMY YADTVKG | 634 | FWSDLDFDH | 649 |
| CD3_sp11a_VHVL_SW | GFTFSK NGMH | 756 | MIYYDSSKMY YADTVKG | 634 | FSWDLDFDH | 650 |
| CD3_SP11A_VHVL_TT | GFTFSK NGMH | 756 | MIYYDSSKMY YADTVKG | 634 | FTTDLDFDH | 651 |
| CD3_SP11A_VHVL_TW | GFTFSK NGMH | 756 | MIYYDSSKMY YADTVKG | 634 | FTWDLDFDH | 652 |
| CD3_SP11A_VHVL_WT | GFTFSK NGMH | 756 | MIYYDSSKMY YADTVKG | 634 | FWTDLDFDH | 653 |
| CD3_SP11A VH3_VLK_3 | GFTFSK NGMH | 756 | MIYYDSSKMY YADTVKG | 634 | FWWDLDFDH | 641 |
| CD3_sp11a_VH1_VK2 | GFTFSK QGMH | 760 | MIYYDSSKMY YADTVKG | 634 | FWWDLDFDH | 641 |
| CD3_SP11A_VH3_VLK1 | GFTFSK NGMH | 756 | MIYYDSSKMY YADTVKG | 634 | FWWDLDFDH | 641 |
| CD3_SP11A_VH5_VK2 | GFTFSK QGMH | 760 | MIYYDSSKMY YADTVKG | 634 | FWWDLDFDH | 641 |
| CD3_sp9aFW1_VL_VH_S56G | GFSLTT YNVH | 757 | RMRYSGDTSF NAALTS | 636 | DPMYIPNYA YGVMNA | 654 |
| CD3_SP9AFW4_VL_VH_S56G | GFSLTT YNVH | 757 | RMRYSGDTSF NAALTS | 636 | DPMYIPNYA YGVMNA | 654 |
| CD3_sp9aFW1_VLVH | GFSLTT YNVH | 757 | RMRYSGDTSF NAALTS | 636 | DPMYIPNYA YGVMNA | 654 |
| CD3_sp9aFW4_VLVH | GFSLTT YNVH | 757 | RMRYSGDTSF NAALTS | 636 | DPMYIPNYA YGVMNA | 654 |
| CD3_sp9arabtor_VHVL | GFSLTT YNVH | 757 | RMRYSGDTSF NAALTS | 636 | DPMYIPNYA YGVMNA | 654 |
| CD3_sp9arabtor_VLVH | GFSLTT YNVH | 757 | RMRYSGDTSF NAALTS | 636 | DPMYIPNYA YGVMNA | 654 |
| CD3_sp11a_VHVL_YY_SANSPTM | GFTFSK QGMH | 760 | MIYYDSSKMY YADTVKG | 634 | FWWDLDFDH | 641 |
| CD3_sp11a_VHVL_YY_SANSPTM_Y | GFTFSK QGMH | 760 | MIYYDSSKMY YADTVKG | 634 | FWWDLDFDH | 641 |
| CD3_sp11a_VHVL_YY_SANSPTM_S | GFTFSK QGMH | 760 | MIYYDSSKMY YADTVKG | 634 | FWWDLDFDH | 641 |
| CD3_sp11a_VHVL_YY_Y | GFTFSK NGMH | 756 | MIYYDSSKMY YADTVKG | 634 | FWWDLDFDH | 641 |
| CD3_sp11a_VHVL_YY_s | GFTFSK NGMH | 756 | MIYYDSSKMY YADTVKG | 634 | FWWDLDFDH | 641 |

TABLE AG-1-continued

CD3 Binders- Heavy Chain CDR sequences according to combination
of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_SS_SANSPTM | GFTFSK QGMH | 760 | MIYYDSSKMY YADTVKG | 634 | FWWDLDFDH | 641 |
| CD3_sp11a_VHVL_SS_SANSPTM_Y | GFTFSK QGMH | 760 | MIYYDSSKMY YADTVKG | 634 | FWWDLDFDH | 641 |
| CD3_sp11a_VHVL_SS_SANSPTM_S | GFTFSK QGMH | 760 | MIYYDSSKMY YADTVKG | 634 | FWWDLDFDH | 641 |
| CD3_sp11a_VHVL_SS_Y | GFTFSK NGMH | 756 | MIYYDSSKMY YADTVKG | 634 | FWWDLDFDH | 641 |
| CD3_sp11a_VHVL_SS_S | GFTFSK NGMH | 756 | MIYYDSSKMY YADTVKG | 634 | FWWDLDFDH | 641 |
| CD3_sp11a_VHVL_SS_SANSPTM | GFTFSK QGMH | 760 | MIYYDSSKMY YADTVKG | 634 | FWWDLDFDH | 641 |
| CD3_sp11a_VHVL_WS_SANSPTM_Y | GFTFSK QGMH | 760 | MIYYDSSKMY YADTVKG | 634 | FWWDLDFDH | 641 |
| CD3_sp11a_VHVL_WS_SANSPTM_S | GFTFSK QGMH | 760 | MIYYDSSKMY YADTVKG | 634 | FWWDLDFDH | 641 |
| CD3_sp11a_VHVL_WS_Y | GFTFSK NGMH | 756 | MIYYDSSKMY YADTVKG | 634 | FWWDLDFDH | 641 |
| CD3_sp11a_VHVL_WS_S | GFTFSK NGMH | 756 | MIYYDSSKMY YADTVKG | 634 | FWWDLDFDH | 641 |
| CD3_sp11a_VHVL_WS_SANSPTM | GFTFSK QGMH | 760 | MIYYDSSKMY YADTVKG | 634 | FWWDLDFDH | 641 |
| CD3_sp11a_VHVL_SW_SANSPTM_Y | GFTFSK QGMH | 760 | MIYYDSSKMY YADTVKG | 634 | FWWDLDFDH | 641 |
| CD3_sp11a_VHVL_SW_SANSPTM_S | GFTFSK QGMH | 760 | MIYYDSSKMY YADTVKG | 634 | FWWDLDFDH | 641 |
| CD3_sp11a_VHVL_SW_Y | GFTFSK NGMH | 756 | MIYYDSSKMY YADTVKG | 634 | FWWDLDFDH | 641 |
| CD3_sp11a_VHVL_SW_S | GFTFSK NGMH | 756 | MIYYDSSKMY YADTVKG | 634 | FWWDLDFDH | 641 |
| CD3_sp11a_VHVL_SW_SANSPTM | GFTFSK QGMH | 760 | MIYYDSSKMY YADTVKG | 634 | FWWDLDFDH | 641 |
| CD3_sp11a_VHVL_TW_SANSPTM_Y | GFTFSK QGMH | 760 | MIYYDSSKMY YADTVKG | 634 | FWWDLDFDH | 641 |
| CD3_sp11a_VHVL_TW_SANSPTM_S | GFTFSK QGMH | 760 | MIYYDSSKMY YADTVKG | 634 | FWWDLDFDH | 641 |
| CD3_sp11a_VHVL_TW_Y | GFTFSK NGMH | 756 | MIYYDSSKMY YADTVKG | 634 | FWWDLDFDH | 641 |
| CD3_sp11a_VHVL_TW_S | GFTFSK NGMH | 756 | MIYYDSSKMY YADTVKG | 634 | FWWDLDFDH | 641 |
| CD3_sp11a_VHVL_TW_SANSPTM | GFTFSK QGMH | 760 | MIYYDSSKMY YADTVKG | 634 | FWWDLDFDH | 641 |
| CD3_sp11a_VHVL_TT_SANSPTM_Y | GFTFSK QGMH | 760 | MIYYDSSKMY YADTVKG | 634 | FWWDLDFDH | 641 |
| CD3_sp11a_VHVL_TT_SANSPTM_S | GFTFSK QGMH | 760 | MIYYDSSKMY YADTVKG | 634 | FWWDLDFDH | 641 |
| CD3_sp11a_VHVL_TT_Y | GFTFSK NGMH | 756 | MIYYDSSKMY YADTVKG | 634 | FWWDLDFDH | 641 |

TABLE AG-1-continued

CD3 Binders- Heavy Chain CDR sequences according to combination
of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_TT_S | GFTFSK NGMH | 756 | MIYYDSSKMY YADTVKG | 634 | FWWDLDFDH | 641 |
| CD3_sp11a_VHVL_TT_SANSPTM | GFTFSK QGMH | 760 | MIYYDSSKMY YADTVKG | 634 | FWWDLDFDH | 641 |
| CD3_SP11AVH3_VLK_3_Y | GFTFSK NGMH | 756 | MIYYDSSKMY YADTVKG | 634 | YWWDLDFDH | 667 |
| CD3_SP11AVH3_VLK_3_S | GFTFSK NGMH | 756 | MIYYDSSKMY YADTVKG | 634 | SWWDLDFDH | 668 |
| CD3_SP11AVH3_VLK_3_Y_PTM | GFTFSK NGMH | 756 | MIYYDSSKMY YADTVKG | 634 | YWWDLDFDH | 667 |
| CD3_SP11AVH3_VLK_3_S_PTM | GFTFSK NGMH | 756 | MIYYDSSKMY YADTVKG | 634 | SWWDLDFDH | 668 |
| CD3_SP11AVH3_VLK_3_Y_SW | GFTFSK NGMH | 756 | MIYYDSSKMY YADTVKG | 634 | YSWDLDFDH | 661 |
| CD3_SP11AVH3_VLK_3_S_SW | GFTFSK NGMH | 756 | MIYYDSSKMY YADTVKG | 634 | SSWDLDFDH | 662 |
| CD3_SP11AVH3_VLK_3_Y_PTM_SW | GFTFSK NGMH | 756 | MIYYDSSKMY YADTVKG | 634 | YSWDLDFDH | 661 |
| CD3_SP11AVH3_VLK_3_S_SWPTM | GFTFSK NGMH | 756 | MIYYDSSKMY YADTVKG | 634 | SSWDLDFDH | 662 |
| CD3_SP11AVH3_VLK_SWPTM | GFTFSK NGMH | 756 | MIYYDSSKMY YADTVKG | 634 | FSWDLDFDH | 650 |
| CD3_SP11AVH3_VLK_3_SW | GFTFSK NGMH | 756 | MIYYDSSKMY YADTVKG | 634 | FSWDLDFDH | 650 |
| CD3_sp11a_VH1_VK2_Y | GFTFSK QGMH | 760 | MIYYDSSKMY YADTVKG | 634 | YWWDLDFDH | 667 |
| CD3_sp11a_VH1_VK2_s | GFTFSK QGMH | 760 | MIYYDSSKMY YADTVKG | 634 | SWWDLDFDH | 668 |
| CD3_sp11a_VH1_VK2_Y_PTM | GFTFSK NGMH | 756 | MIYYDSSKMY YADTVKG | 634 | YWWDLDFDH | 667 |
| CD3_sp11a_VH1_VK2_S_PTM | GFTFSK NGMH | 756 | MIYYDSSKMY YADTVKG | 634 | SWWDLDFDH | 668 |
| CD3_sp11a_VH1_VK2_Y_SW | GFTFSK QGMH | 760 | MIYYDSSKMY YADTVKG | 634 | YSWDLDFDH | 661 |
| CD3_sp11a_VH1_VK2_S_SW | GFTFSK QGMH | 760 | MIYYDSSKMY YADTVKG | 634 | SSWDLDFDH | 662 |
| CD3_sp11a_VH1_VK2_Y_PTM | GFTFSK NGMH | 756 | MIYYDSSKMY YADTVKG | 634 | YSWDLDFDH | 661 |
| CD3_sp11a_VH1_VK2_S_PTM_SW | GFTFSK NGMH | 756 | MIYYDSSKMY YADTVKG | 634 | SSWDLDFDH | 662 |
| CD3_sp11a_VH1_VK2_SW | GFTFSK QGMH | 760 | MIYYDSSKMY YADTVKG | 634 | FSWDLDFDH | 650 |
| CD3_sp11a_VH1_VK2_SW_PTM | GFTFSK NGMH | 756 | MIYYDSSKMY YADTVKG | 634 | FSWDLDFDH | 650 |
| CD3_SP11A_VH3_VLK1_Y | GFTFSK NGMH | 756 | MIYYDSSKMY YADTVKG | 634 | YWWDLDFDH | 667 |
| CD3_SP11A_VH3_VLK1_S | GFTFSK NGMH | 756 | MIYYDSSKMY YADTVKG | 634 | SWWDLDFDH | 668 |
| CD3_SP11A_VH3_VLK1_Y_PTM | GFTFSK QGMH | 760 | MIYYDSSKMY YADTVKG | 634 | YWWDLDFDH | 667 |

TABLE AG-1-continued

| CD3 Binders- Heavy Chain CDR sequences according to combination of Kabat and Chothia numbering schemes | | | | | | |
|---|---|---|---|---|---|---|
| Binder | CDR-H1 | SEQ ID NO: | CDR-H2 | SEQ ID NO: | CDR-H3 | SEQ ID NO: |
| CD3_SP11A_VH3_VLK1_S_PTM | GFTFSK QGMH | 760 | MIYYDSSKMY YADTVKG | 634 | SWWDLDFDH | 668 |
| CD3_SP11A_VH3_VLK1_Y_SW | GFTFSK NGMH | 756 | MIYYDSSKMY YADTVKG | 634 | YSWDLDFDH | 661 |
| CD3_SP11A_VH3_VLK1_S_SW | GFTFSK NGMH | 756 | MIYYDSSKMY YADTVKG | 634 | SSWDLDFDH | 662 |
| CD3_SP11A_VH3_VLK1_Y_PTM | GFTFSK QGMH | 760 | MIYYDSSKMY YADTVKG | 634 | YWWDLDFDH | 667 |
| CD3_SP11A_VH3_VLK1_S_PTM_SW | GFTFSK QGMH | 760 | MIYYDSSKMY YADTVKG | 634 | SSWDLDFDH | 662 |
| CD3_SP11A_VH3_VLK1PTM_SW | GFTFSK QGMH | 760 | MIYYDSSKMY YADTVKG | 634 | FSWDLDFDH | 650 |
| CD3_SP11A_VH3_VLK1_SW | GFTFSK NGMH | 756 | MIYYDSSKMY YADTVKG | 634 | FSWDLDFDH | 650 |
| CD3_SP11A_VH5_VK2_Y | GFTFSK QGMH | 760 | MIYYDSSKMY YADTVKG | 634 | YWWDLDFDH | 667 |
| CD3_SP11A_VH5_VK2_S | GFTFSK QGMH | 760 | MIYYDSSKMY YADTVKG | 634 | SWWDLDFDH | 668 |
| CD3_SP11A_VH5_VK2_Y_PTM | GFTFSK NGMH | 756 | MIYYDSSKMY YADTVKG | 634 | YWWDLDFDH | 667 |
| CD3_SP11A_VH5_VK2_S_PTM | GFTFSK NGMH | 756 | MIYYDSSKMY YADTVKG | 634 | SWWDLDFDH | 668 |
| CD3_SP11A_VH5_VK2_Y_SW | GFTFSK QGMH | 760 | MIYYDSSKMY YADTVKG | 634 | YSWDLDFDH | 661 |
| CD3_SP11A_VH5_VK2_S_SW | GFTFSK QGMH | 760 | MIYYDSSKMY YADTVKG | 634 | SSWDLDFDH | 662 |
| CD3_SP11A_VH5_VK2_Y_PTM_SW | GFTFSK NGMH | 756 | MIYYDSSKMY YADTVKG | 634 | YSWDLDFDH | 661 |
| CD3_SP11A_VH5_VK2_S_PTM_SW | GFTFSK NGMH | 756 | MIYYDSSKMY YADTVKG | 634 | SSWDLDFDH | 662 |
| CD3_SP11A_VH5_VK2_PTM_SW | GFTFSK NGMH | 756 | MIYYDSSKMY YADTVKG | 634 | FSWDLDFDH | 650 |
| CD3_SP11A_VH5_VK2_SW | GFTFSK QGMH | 760 | MIYYDSSKMY YADTVKG | 634 | FSWDLDFDH | 650 |

TABLE AG-2

| CD3 Binders- Light Chain CDR sequences according to combination of Kabat and Chothia numbering schemes | | | | | | |
|---|---|---|---|---|---|---|
| Binder | CDR-L1 | SEQ ID NO: | CDR-L2 | SEQ ID NO: | CDR-L3 | SEQ ID NO: |
| NOV292 | RSSQSLVRSD GTTYFN | 669 | RVSN RFS | 624 | LQSSHFP WT | 680 |
| NOV123 | RSSQSLIY-SIGN TYLH | 670 | RVSN RFS | 624 | FQSTHLP YT | 626 |
| Sp10b | RSSQSLIY-SIGN TYLH | 670 | RVSN RFS | 624 | FQSTHLP YT | 626 |

TABLE AG-2-continued

CD3 Binders- Light Chain CDR sequences according to
combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| NOV453 | KASQNINNYLN | 671 | NTDH LQA | 677 | LQHRSR YT | 681 |
| NOV229 | KASQNINNYLN | 671 | NTDH LQA | 677 | LQHRSR YT | 681 |
| NOV110 | RSSQSLVYSH GNTYLH | 672 | RVSN RFS | 624 | FQSTHLP YT | 626 |
| NOV832 | RSSQSLVYSH GNTYLH | 672 | RVSN RFS | 624 | FQSTHLP YT | 626 |
| NOV589 | RSSQSLVRSD GTTYFN | 669 | RVSN RFS | 624 | LQSSHFP WT | 680 |
| NOV580 | KTSQNIDKYLN | 673 | NTNN LEA | 678 | LQHRSS YT | 682 |
| NOV567 | RGSQSIGNSLN | 674 | STSTL EY | 679 | LQYATYP YT | 683 |
| NOV221 | KSSQNIDKYLN | 675 | NTNN LEA | 678 | LQHRSG YT | 684 |
| CD3_sp11a_bkm1 | RSSQSLVRSD GTTYFN | 669 | RVSN RFS | 624 | LQSSHFP WT | 680 |
| CD3_SP11a_bkm2 | RSSQSLVRSD GTTYFN | 669 | RVSN RFS | 624 | LQSSHFP WT | 680 |
| CD3_sp11_a_hz0 | RSSQSLVRSD GTTYFN | 669 | RVSN RFS | 624 | LQSSHFP WT | 680 |
| CD3_SP11A_HZ1 | RSSQSLVRSD GTTYFN | 669 | RVSN RFS | 624 | LQSSH | 685 |
| CD3_sp11a_sansPTM_hz1 | RSSQSLVRSE GTTYFN | 676 | RVSN RFS | 624 | LQSSHFP WT | 680 |
| CD3_sp11a_sansPTM_rat | RSSQSLVRSE GTTYFN | 676 | RVSN RFS | 624 | LQSSHFP WT | 680 |
| CD3_sp11a_VHVL_YY | RSSQSLVRSD GTTYFN | 669 | RVSN RFS | 624 | LQSSHFP WT | 680 |
| CD3_SP11A_VHVL_SS | RSSQSLVRSD GTTYFN | 669 | RVSN RFS | 624 | LQSSHFP WT | 680 |
| CD3_SP11A_VHVL_WS | RSSQSLVRSD GTTYFN | 669 | RVSN RFS | 624 | LQSSHFP WT | 680 |
| CD3_sp11a_VHVL_SW | RSSQSLVRSD GTTYFN | 669 | RVSN RFS | 624 | LQSSHFP WT | 680 |
| CD3_SP11A_VHVL_TT | RSSQSLVRSD GTTYFN | 669 | RVSN RFS | 624 | LQSSHFP WT | 680 |
| CD3_SP11A_VHVL_TW | RSSQSLVRSD GTTYFN | 669 | RVSN RFS | 624 | LQSSHFP WT | 680 |
| CD3_SP11A_VHVL_WT | RSSQSLVRSD GTTYFN | 669 | RVSN RFS | 624 | LQSSHFP WT | 680 |
| CD3_SP11A VH3_VLK_3 | RSSQSLVRSE GTTYFN | 676 | RVSN RFS | 624 | LQSSHFP WT | 680 |
| CD3_sp11a_VH1_VK2 | RSSQSLVRSD GTTYFN | 669 | RVSN RFS | 624 | LQSSHFP WT | 680 |
| CD3_SP11A_VH3_VLK1 | RSSQSLVRSE GTTYFN | 676 | RVSN RFS | 624 | LQSSHFP WT | 680 |
| CD3_SP11A_VH5_VK2 | RSSQSLVRSD GTTYFN | 669 | RVSN RFS | 624 | LQSSHFP WT | 680 |

TABLE AG-2-continued

CD3 Binders- Light Chain CDR sequences according to
combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp9aFW1_VL_VH_S5 6G | KASQNINNYLN | 671 | NTDH LQA | 677 | LQHRSR YT | 681 |
| CD3_SP9AFW4_VL_VH_S 56G | KASQNINNYLN | 671 | NTDH LQA | 677 | LQHRSR YT | 681 |
| CD3_sp9aFW1_VLVH | KASQNINNYLN | 671 | NTDH LQA | 677 | LQHRSR YT | 681 |
| CD3_sp9aFW4_VLVH | KASQNINNYLN | 671 | NTDH LQA | 677 | LQHRSR YT | 681 |
| CD3_sp9arabtor_VHVL | KASQNINNYLN | 671 | NTDH LQA | 677 | LQHRSR YT | 681 |
| CD3_sp9arabtor_VLVH | KASQNINNYLN | 671 | NTDH LQA | 677 | LQHRSR YT | 681 |
| CD3_sp11a_VHVL_YY_SA NSPTM | RSSQSLVRSE GTTYFN | 676 | RVSN RFS | 624 | LQSSHFP WT | 680 |
| CD3_sp11a_VHVL_YY_SA NSPTM_Y | RSSQSLVRSE GTTYFN | 676 | RVSN RFS | 624 | LQSSHFP WT | 680 |
| CD3_sp11a_VHVL_YY_SA NSPTM_S | RSSQSLVRSE GTTYFN | 676 | RVSN RFS | 624 | LQSSHFP WT | 680 |
| CD3_sp11a_VHVL_YY_Y | RSSQSLVRSD GTTYFN | 669 | RVSN RFS | 624 | LQSSHFP WT | 680 |
| CD3_sp11a_VHVL_YY_s | RSSQSLVRSD GTTYFN | 669 | RVSN RFS | 624 | LQSSHFP WT | 680 |
| CD3_sp11a_VHVL_SS_SA NSPTM | RSSQSLVRSE GTTYFN | 676 | RVSN RFS | 624 | LQSSHFP WT | 680 |
| CD3_sp11a_VHVL_SS_SA NSPTM_Y | RSSQSLVRSE GTTYFN | 676 | RVSN RFS | 624 | LQSSHFP WT | 680 |
| CD3_sp11a_VHVL_SS_SA NSPTM_S | RSSQSLVRSE GTTYFN | 676 | RVSN RFS | 624 | LQSSHFP WT | 680 |
| CD3_sp11a_VHVL_SS_Y | RSSQSLVRSD GTTYFN | 669 | RVSN RFS | 624 | LQSSHFP WT | 680 |
| CD3_sp11a_VHVL_SS_S | RSSQSLVRSD GTTYFN | 669 | RVSN RFS | 624 | LQSSHFP WT | 680 |
| CD3_sp11a_VHVL_SS _SANSPTM | RSSQSLVRSE GTTYFN | 676 | RVSN RFS | 624 | LQSSHFP WT | 680 |
| CD3_sp11a_VHVL_WS _SANSPTM_Y | RSSQSLVRSE GTTYFN | 676 | RVSN RFS | 624 | LQSSHFP WT | 680 |
| CD3_sp11a_VHVL_WS _SANSPTM_S | RSSQSLVRSE GTTYFN | 676 | RVSN RFS | 624 | LQSSHFP WT | 680 |
| CD3_sp11a_VHVL_WS _Y | RSSQSLVRSD GTTYFN | 669 | RVSN RFS | 624 | LQSSHFP WT | 680 |
| CD3_sp11a_VHVL_WS _S | RSSQSLVRSD GTTYFN | 669 | RVSN RFS | 624 | LQSSHFP WT | 680 |
| CD3_sp11a_VHVL_WS _SANSPTM | RSSQSLVRSE GTTYFN | 676 | RVSN RFS | 624 | LQSSHFP WT | 680 |
| CD3_sp11a_VHVL_SW _SANSPTM_Y | RSSQSLVRSE GTTYFN | 676 | RVSN RFS | 624 | LQSSHFP WT | 680 |
| CD3_sp11a_VHVL_SW _SANSPTM_S | RSSQSLVRSE GTTYFN | 676 | RVSN RFS | 624 | LQSSHFP WT | 680 |

TABLE AG-2-continued

CD3 Binders- Light Chain CDR sequences according to
combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_SW_Y | RSSQSLVRSD GTTYFN | 669 | RVSN RFS | 624 | LQSSHFP WT | 680 |
| CD3_sp11a_VHVL_SW_S | RSSQSLVRSD GTTYFN | 669 | RVSN RFS | 624 | LQSSHFP WT | 680 |
| CD3_sp11a_VHVL_SW_SANSPTM | RSSQSLVRSE GTTYFN | 676 | RVSN RFS | 624 | LQSSHFP WT | 680 |
| CD3_sp11a_VHVL_TW_SANSPTM_Y | RSSQSLVRSE GTTYFN | 676 | RVSN RFS | 624 | LQSSHFP WT | 680 |
| CD3_sp11a_VHVL_TW_SANSPTM_S | RSSQSLVRSE GTTYFN | 676 | RVSN RFS | 624 | LQSSHFP WT | 680 |
| CD3_sp11a_VHVL_TW_Y | RSSQSLVRSD GTTYFN | 669 | RVSN RFS | 624 | LQSSHFP WT | 680 |
| CD3_sp11a_VHVL_TW_S | RSSQSLVRSD GTTYFN | 669 | RVSN RFS | 624 | LQSSHFP WT | 680 |
| CD3_sp11a_VHVL_TW_SANSPTM | RSSQSLVRSE GTTYFN | 676 | RVSN RFS | 624 | LQSSHFP WT | 680 |
| CD3_sp11a_VHVL_TT_SANSPTM_Y | RSSQSLVRSE GTTYFN | 676 | RVSN RFS | 624 | LQSSHFP WT | 680 |
| CD3_sp11a_VHVL_TT_SANSPTM_S | RSSQSLVRSE GTTYFN | 676 | RVSN RFS | 624 | LQSSHFP WT | 680 |
| CD3_sp11a_VHVL_TT_Y | RSSQSLVRSD GTTYFN | 669 | RVSN RFS | 624 | LQSSHFP WT | 680 |
| CD3_sp11a_VHVL_TT_S | RSSQSLVRSD GTTYFN | 669 | RVSN RFS | 624 | LQSSHFP WT | 680 |
| CD3_sp11a_VHVL_TT_SANSPTM | RSSQSLVRSE GTTYFN | 676 | RVSN RFS | 624 | LQSSHFP WT | 680 |
| CD3_SP11AVH3_VLK_3_Y | RSSQSLVRSE GTTYFN | 676 | RVSN RFS | 624 | LQSSHFP WT | 680 |
| CD3_SP11AVH3_VLK_3_S | RSSQSLVRSE GTTYFN | 676 | RVSN RFS | 624 | LQSSHFP WT | 680 |
| CD3_SP11AVH3_VLK_3_Y_PTM | RSSQSLVRSD GTTYFN | 669 | RVSN RFS | 624 | LQSSHFP WT | 680 |
| CD3_SP11AVH3_VLK_3_S_PTM | RSSQSLVRSD GTTYFN | 669 | RVSN RFS | 624 | LQSSHFP WT | 680 |
| CD3_SP11AVH3_VLK_3_Y_SW | RSSQSLVRSE GTTYFN | 676 | RVSN RFS | 624 | LQSSHFP WT | 680 |
| CD3_SP11AVH3_VLK_3_S_SW | RSSQSLVRSE GTTYFN | 676 | RVSN RFS | 624 | LQSSHFP WT | 680 |
| CD3_SP11AVH3_VLK_3_Y_PTM_SW | RSSQSLVRSD GTTYFN | 669 | RVSN RFS | 624 | LQSSHFP WT | 680 |
| CD3_SP11AVH3_VLK_3_S_SWPTM | RSSQSLVRSD GTTYFN | 669 | RVSN RFS | 624 | LQSSHFP WT | 680 |
| CD3_SP11AVH3_VLK_SW PTM | RSSQSLVRSD GTTYFN | 669 | RVSN RFS | 624 | LQSSHFP WT | 680 |
| CD3_SP11AVH3_VLK_3_SW | RSSQSLVRSE GTTYFN | 676 | RVSN RFS | 624 | LQSSHFP WT | 680 |
| CD3_sp11a_VH1_VK2_Y | RSSQSLVRSD GTTYFN | 669 | RVSN RFS | 624 | LQSSHFP WT | 680 |
| CD3_sp11a_VH1_VK2_S | RSSQSLVRSD GTTYFN | 669 | RVSN RFS | 624 | LQSSHFP WT | 680 |

TABLE AG-2-continued

CD3 Binders- Light Chain CDR sequences according to
combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2_Y_PTM | RSSQSLVRSE GTTYFN | 676 | RVSN RFS | 624 | LQSSHFP WT | 680 |
| CD3_sp11a_VH1_VK2_S_PTM | RSSQSLVRSE GTTYFN | 676 | RVSN RFS | 624 | LQSSHFP WT | 680 |
| CD3_sp11a_VH1_VK2_Y_SW | RSSQSLVRSD GTTYFN | 669 | RVSN RFS | 624 | LQSSHFP WT | 680 |
| CD3_sp11a_VH1_VK2_S_SW | RSSQSLVRSD GTTYFN | 669 | RVSN RFS | 624 | LQSSHFP WT | 680 |
| CD3_sp11a_VH1_VK2_Y_PTM | RSSQSLVRSE GTTYFN | 676 | RVSN RFS | 624 | LQSSHFP WT | 680 |
| CD3_sp11a_VH1_VK2_S_PTM_SW | RSSQSLVRSE GTTYFN | 676 | RVSN RFS | 624 | LQSSHFP WT | 680 |
| CD3_sp11a_VH1_VK2_S_W | RSSQSLVRSD GTTYFN | 669 | RVSN RFS | 624 | LQSSHFP WT | 680 |
| CD3_sp11a_VH1_VK2_S_W_PTM | RSSQSLVRSE GTTYFN | 676 | RVSN RFS | 624 | LQSSHFP WT | 680 |
| CD3_SP11A_VH3_VLK1_Y | RSSQSLVRSE GTTYFN | 676 | RVSN RFS | 624 | LQSSHFP WT | 680 |
| CD3_SP11A_VH3_VLK1_S | RSSQSLVRSE GTTYFN | 676 | RVSN RFS | 624 | LQSSHFP WT | 680 |
| CD3_SP11A_VH3_VLK1_Y_PTM | RSSQSLVRSE GTTYFN | 676 | RVSN RFS | 624 | LQSSHFP WT | 680 |
| CD3_SP11A_VH3_VLK1_S_PTM | RSSQSLVRSD GTTYFN | 669 | RVSN RFS | 624 | LQSSHFP WT | 680 |
| CD3_SP11A_VH3_VLK1_Y_SW | RSSQSLVRSE GTTYFN | 676 | RVSN RFS | 624 | LQSSHFP WT | 680 |
| CD3_SP11A_VH3_VLK1_S_SW | RSSQSLVRSE GTTYFN | 676 | RVSN RFS | 624 | LQSSHFP WT | 680 |
| CD3_SP11A_VH3_VLK1_Y_PTM | RSSQSLVRSE GTTYFN | 676 | RVSN RFS | 624 | LQSSHFP WT | 680 |
| CD3_SP11A_VH3_VLK1_S_PTM_SW | RSSQSLVRSD GTTYFN | 669 | RVSN RFS | 624 | LQSSHFP WT | 680 |
| CD3_SP11 A_VH3_VLK1PTM_SW | RSSQSLVRSD GTTYFN | 669 | RVSN RFS | 624 | LQSSHFP WT | 680 |
| CD3_SP11A_VH3_VLK1_SW | RSSQSLVRSE GTTYFN | 676 | RVSN RFS | 624 | LQSSHFP WT | 680 |
| CD3_SP11A_VH5_VK2_Y | RSSQSLVRSD GTTYFN | 669 | RVSN RFS | 624 | LQSSHFP WT | 680 |
| CD3_SP11A_VH5_VK2_S | RSSQSLVRSD GTTYFN | 669 | RVSN RFS | 624 | LQSSHFP WT | 680 |
| CD3_SP11A_VH5_VK2_Y_PTM | RSSQSLVRSD GTTYFN | 669 | RVSN RFS | 624 | LQSSHFP WT | 680 |
| CD3_SP11A_VH5_VK2_S_PTM | RSSQSLVRSD GTTYFN | 669 | RVSN RFS | 624 | LQSSHFP WT | 680 |
| CD3_SP11A_VH5_VK2_Y_SW | RSSQSLVRSD GTTYFN | 669 | RVSN RFS | 624 | LQSSHFP WT | 680 |
| CD3_SP11A_VH5_VK2_S_SW | RSSQSLVRSD GTTYFN | 669 | RVSN RFS | 624 | LQSSHFP WT | 680 |

TABLE AG-2-continued

CD3 Binders- Light Chain CDR sequences according to
combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2_Y _PTM_SW | RSSQSLVRSD GTTYFN | 669 | RVSN RFS | 624 | LQSSHFP WT | 680 |
| CD3_SP11A_VH5_VK2_S _PTM_SW | RSSQSLVRSD GTTYFN | 669 | RVSN RFS | 624 | LQSSHFP WT | 680 |
| CD3_SP11A_VH5_VK2_P TM_SW | RSSQSLVRSD GTTYFN | 669 | RVSN RFS | 624 | LQSSHFP WT | 680 |
| CD3_SP11A_VH5_VK2_S W | RSSQSLVRSD GTTYFN | 669 | RVSN RFS | 624 | LQSSHFP WT | 680 |

TABLE AH-1

CD3 Binders- Heavy Chain CDR sequences according to
combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV292 | GFTFSK NGMH | 756 | MIYYDSSKMY YADTVKG | 634 | ASFWWDLDF DH | 715 |
| NOV123 | GYTFTS YYIY | 613 | YIYPGHDAIYY SENFKG | 635 | VRPNTMMAPL AY | 716 |
| Sp10b | GYTFTS YYIY | 613 | YIYPGHDAIYY SENFKG | 635 | VRPNTMMAPL AY | 716 |
| NOV453 | GFSLTT YNVH | 757 | RMRYSGDTSF NAALTS | 636 | TSDPMYIPNY SYGVMNA | 717 |
| NOV229 | GFSLTT YNVH | 757 | RMRYSGDTSF NAALTS | 636 | ARDPMYIPNY SYGVMNA | 718 |
| NOV110 | GYTFTS YYIY | 613 | YIYPANGGIYY SEKFKG | 637 | ARPVTMMAPL VF | 719 |
| NOV832 | GYTFTS YYIY | 613 | YIYPANGGIYY SEKFKG | 637 | ARPVTMMAPL VF | 719 |
| NOV589 | GFTFSK NGMH | 756 | MIYYDSSRMY YADTVKG | 638 | ASFWWDLDF DY | 720 |
| NOV580 | GFSLTT YNIH | 758 | RMRYSGDTS YSSALKS | 639 | TRDPMYIPGY SYGVMNA | 721 |
| NOV567 | GFAFRK YGMS | 759 | LIYYDSSKMN YADTVKG | 640 | AALNSEYD | 582 |
| NOV221 | GFSLTT YNIH | 758 | RMRYSGDTS YSSALKS | 639 | TRDPMYIPGY SYGVMNA | 721 |
| CD3_sp11a_bkm1 | GFTFSK NGMH | 756 | MIYYDSSKMY YADTVKG | 634 | ASFWWDLDF DH | 715 |
| CD3_SP11a_bkm2 | GFTFSK NGMH | 756 | MIYYDSSKMY YADTVKG | 634 | AKFWWDLDF DH | 722 |
| CD3_sp11a_hz0 | GFTFSK NGMH | 756 | MIYYDSSKMY YADTVKG | 634 | AKFWWDLDF DH | 722 |
| CD3_SP11A_HZ1 | GFTFSK NGMH | 756 | MIYYDSSKMY YADTVKG | 634 | ASFWWDLDF DH | 715 |
| CD3_sp11a_sansPTM _hz1 | GFTFSK QGMH | 760 | MIYYDSSKMY YADTVKG | 634 | ASFWWDLDF DH | 715 |
| CD3_sp11a_sansPTM _rat | GFTFSK QGMH | 760 | MIYYDSSKMY YADTVKG | 634 | ASFWWDLDF DH | 715 |

TABLE AH-1-continued

CD3 Binders- Heavy Chain CDR sequences according to
combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_YY | GFTFSK NGMH | 756 | MIYYDSSKMY YADTVKG | 634 | ASFYYDLDFD H | 723 |
| CD3_SP11A_VHVL_S S | GFTFSK NGMH | 756 | MIYYDSSKMY YADTVKG | 634 | ASFSSDLDFD H | 724 |
| CD3_SP11A_VHVL_W S | GFTFSK NGMH | 756 | MIYYDSSKMY YADTVKG | 634 | ASFWSDLDFD H | 725 |
| CD3_sp11a_VHVL_S W | GFTFSK NGMH | 756 | MIYYDSSKMY YADTVKG | 634 | ASFSWDLDFD H | 726 |
| CD3_SP11A_VHVL_T T | GFTFSK NGMH | 756 | MIYYDSSKMY YADTVKG | 634 | ASFTTDLDFD H | 727 |
| CD3_SP11A_VHVL_T W | GFTFSK NGMH | 756 | MIYYDSSKMY YADTVKG | 634 | ASFTWDLDFD H | 728 |
| CD3_SP11A_VHVL_W T | GFTFSK NGMH | 756 | MIYYDSSKMY YADTVKG | 634 | ASFWTDLDFD H | 729 |
| CD3_SP11A VH3_VLK_3 | GFTFSK NGMH | 756 | MIYYDSSKMY YADTVKG | 634 | ASFWWDLDF DH | 715 |
| CD3_sp11a_VH1_VK2 | GFTFSK QGMH | 760 | MIYYDSSKMY YADTVKG | 634 | ASFWWDLDF DH | 715 |
| CD3_SP11A_VH3_VL K1 | GFTFSK NGMH | 756 | MIYYDSSKMY YADTVKG | 634 | ASFWWDLDF DH | 715 |
| CD3_SP11A_VH5_VK 2 | GFTFSK QGMH | 760 | MIYYDSSKMY YADTVKG | 634 | ASFWWDLDF DH | 715 |
| CD3_sp9aFW1_VL_V H_S56G | GFSLTT YNVH | 757 | RMRYSGDTSF NAALTS | 636 | ASDPMYIPNY AYGVMNA | 730 |
| CD3_SP9AFW4_VL_V H_S56G | GFSLTT YNVH | 757 | RMRYSGDTSF NAALTS | 636 | ASDPMYIPNY AYGVMNA | 730 |
| CD3_sp9aFW1_VLVH | GFSLTT YNVH | 757 | RMRYSGDTSF NAALTS | 636 | ASDPMYIPNY AYGVMNA | 730 |
| CD3_sp9aFW4_VLVH | GFSLTT YNVH | 757 | RMRYSGDTSF NAALTS | 636 | ASDPMYIPNY AYGVMNA | 730 |
| CD3_sp9arabtor_VHVL | GFSLTT YNVH | 757 | RMRYSGDTSF NAALTS | 636 | ASDPMYIPNY AYGVMNA | 730 |
| CD3_sp9arabtor_VLVH | GFSLTT YNVH | 757 | RMRYSGDTSF NAALTS | 636 | ASDPMYIPNY AYGVMNA | 730 |
| CD3_SP11AVH3_VLK _3_Y | GFTFSK NGMH | 756 | MIYYDSSKMY YADTVKG | 634 | ASYWWDLDF DH | 743 |
| CD3_SP11AVH3_VLK _3_S | GFTFSK NGMH | 756 | MIYYDSSKMY YADTVKG | 634 | ASSWWDLDF DH | 744 |
| CD3_SP11AVH3_VLK _3_Y_PTM | GFTFSK NGMH | 756 | MIYYDSSKMY YADTVKG | 634 | ASYVWVDLDF DH | 743 |
| CD3_SP11AVH3_VLK _3_S_PTM | GFTFSK NGMH | 756 | MIYYDSSKMY YADTVKG | 634 | ASSWWDLDF DH | 744 |
| CD3_SP11AVH3_VLK _3_Y_SW | GFTFSK NGMH | 756 | MIYYDSSKMY YADTVKG | 634 | ASYSWDLDFD H | 737 |
| CD3_SP11AVH3_VLK _3_S_SW | GFTFSK NGMH | 756 | MIYYDSSKMY YADTVKG | 634 | ASSSWDLDFD H | 738 |
| CD3_SP11AVH3_VLK _3_Y_PTM_SW | GFTFSK NGMH | 756 | MIYYDSSKMY YADTVKG | 634 | ASYSWDLDFD H | 737 |
| CD3_SP11AVH3_VLK _3_S_SWPTM | GFTFSK NGMH | 756 | MIYYDSSKMY YADTVKG | 634 | ASSSWDLDFD H | 738 |

TABLE AH-1-continued

CD3 Binders- Heavy Chain CDR sequences according to
combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11AVH3_VLK _SWPTM | GFTFSK NGMH | 756 | MIYYDSSKMY YADTVKG | 634 | ASFSWDLDFD H | 726 |
| CD3_SP11AVH3_VLK _3_SW | GFTFSK NGMH | 756 | MIYYDSSKMY YADTVKG | 634 | ASFSWDLDFD H | 726 |
| CD3_sp11a_VH1_VK2 _Y | GFTFSK QGMH | 760 | MIYYDSSKMY YADTVKG | 634 | ASYWWDLDF DH | 743 |
| CD3_sp11a_VH1_VK2 _S | GFTFSK QGMH | 760 | MIYYDSSKMY YADTVKG | 634 | ASSWWDLDF DH | 744 |
| CD3_sp11a_VH1_VK2 _Y_PTM | GFTFSK NGMH | 756 | MIYYDSSKMY YADTVKG | 634 | ASYWWDLDF DH | 743 |
| CD3_sp11a_VH1_VK2 _S_PTM | GFTFSK NGMH | 756 | MIYYDSSKMY YADTVKG | 634 | ASSWWDLDF DH | 744 |
| CD3_sp11a_VH1_VK2 _Y_SW | GFTFSK QGMH | 760 | MIYYDSSKMY YADTVKG | 634 | ASYSWDLDFD H | 737 |
| CD3_sp11a_VH1_VK2 _S_SW | GFTFSK QGMH | 760 | MIYYDSSKMY YADTVKG | 634 | ASSSWDLDFD H | 738 |
| CD3_sp11a_VH1_VK2 _Y_PTM | GFTFSK NGMH | 756 | MIYYDSSKMY YADTVKG | 634 | ASYSWDLDFD H | 737 |
| CD3_sp11a_VH1_VK2 _S_PTM_SW | GFTFSK NGMH | 756 | MIYYDSSKMY YADTVKG | 634 | ASSSWDLDFD H | 738 |
| CD3_sp11a_VH1_VK2 _SW | GFTFSK QGMH | 760 | MIYYDSSKMY YADTVKG | 634 | ASFSWDLDFD H | 726 |
| CD3_sp11a_VH1_VK2 _SW_PTM | GFTFSK NGMH | 756 | MIYYDSSKMY YADTVKG | 634 | ASFSWDLDFD H | 726 |
| CD3_SP11A_VH3_VL K1_Y | GFTFSK NGMH | 756 | MIYYDSSKMY YADTVKG | 634 | ASYVWVDLDF DH | 743 |
| CD3_SP11A_VH3_VL K1_S | GFTFSK NGMH | 756 | MIYYDSSKMY YADTVKG | 634 | ASSWWDLDF DH | 744 |
| CD3_SP11A_VH3_VL K1_Y_PTM | GFTFSK QGMH | 760 | MIYYDSSKMY YADTVKG | 634 | ASYVWVDLDF DH | 743 |
| CD3_SP11A_VH3_VL K1_S_PTM | GFTFSK QGMH | 760 | MIYYDSSKMY YADTVKG | 634 | ASSWWDLDF DH | 744 |
| CD3_SP11A_VH3_VL K1_Y_SW | GFTFSK NGMH | 756 | MIYYDSSKMY YADTVKG | 634 | ASYSWDLDFD H | 737 |
| CD3_SP11A_VH3_VL K1_S_SW | GFTFSK NGMH | 756 | MIYYDSSKMY YADTVKG | 634 | ASSSWDLDFD H | 738 |
| CD3_SP11A_VH3_VL K1_Y_PTM | GFTFSK QGMH | 760 | MIYYDSSKMY YADTVKG | 634 | ASYVWVDLDF DH | 743 |
| CD3_SP11A_VH3_VL K1_S_PTM_SW | GFTFSK QGMH | 760 | MIYYDSSKMY YADTVKG | 634 | ASSSWDLDFD H | 738 |
| CD3_SP11A_VH3_VL K1PTM_SW | GFTFSK QGMH | 760 | MIYYDSSKMY YADTVKG | 634 | ASFSWDLDFD H | 726 |
| CD3_SP11A_VH3_VL K1_SW | GFTFSK NGMH | 756 | MIYYDSSKMY YADTVKG | 634 | ASFSWDLDFD H | 726 |
| CD3_SP11A_VH5_VK 2_Y | GFTFSK QGMH | 760 | MIYYDSSKMY YADTVKG | 634 | ASYVWVDLDF DH | 743 |
| CD3_SP11A_VH5_VK 2_S | GFTFSK QGMH | 760 | MIYYDSSKMY YADTVKG | 634 | ASSWWDLDF DH | 744 |

TABLE AH-1-continued

| | | SEQ ID | | SEQ ID | | SEQ ID |
|---|---|---|---|---|---|---|
| | | NO: | | NO: | | NO: |
| Binder | CDR-H1 | NO: | CDR-H2 | NO: | CDR-H3 | NO: |
| CD3_SP11A_VH5_VK 2_Y_PTM | GFTFSK NGMH | 756 | MIYYDSSKMY YADTVKG | 634 | ASYVWVDLDF DH | 743 |
| CD3_SP11A_VH5_VK 2_S_PTM | GFTFSK NGMH | 756 | MIYYDSSKMY YADTVKG | 634 | ASSWWDLDF DH | 744 |
| CD3_SP11A_VH5_VK 2_Y_SW | GFTFSK QGMH | 760 | MIYYDSSKMY YADTVKG | 634 | ASYSWDLDFD H | 737 |
| CD3_SP11A_VH5_VK 2_S_SW | GFTFSK QGMH | 760 | MIYYDSSKMY YADTVKG | 634 | ASSSWDLDFD H | 738 |
| CD3_SP11A_VH5_VK 2_Y_PTM_SW | GFTFSK NGMH | 756 | MIYYDSSKMY YADTVKG | 634 | ASYSWDLDFD H | 737 |
| CD3_SP11A_VH5_VK 2_S_PTM_SW | GFTFSK NGMH | 756 | MIYYDSSKMY YADTVKG | 634 | ASSSWDLDFD H | 738 |
| CD3_SP11A_VH5_VK 2_PTM_SW | GFTFSK NGMH | 756 | MIYYDSSKMY YADTVKG | 634 | ASFSWDLDFD H | 726 |
| CD3_SP11A_VH5_VK 2_SW | GFTFSK QGMH | 760 | MIYYDSSKMY YADTVKG | 634 | ASFSWDLDFD H | 726 |

TABLE AH-2

CD3 Binders-Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| NOV292 | RSSQSLVRSD GTTYFN | 669 | RVSNRF S | 624 | LQSSHF PWT | 680 |
| NOV123 | RSSQSLIYSIG NTYLH | 670 | RVSNRF S | 624 | FQSTHL PYT | 626 |
| Sp10b | RSSQSLIYSIG NTYLH | 670 | RVSNRF S | 624 | FQSTHL PYT | 626 |
| NOV453 | KASQNINNYLN | 671 | NTDHLQ AGVP | 753 | LQHRSR YT | 681 |
| NOV229 | KASQNINNYLN | 671 | NTDHLQ AGVP | 753 | LQHRSR YT | 681 |
| NOV110 | RSSQSLVYSH GNTYLH | 672 | RVSNRF S | 624 | FQSTHL PYT | 626 |
| NOV832 | RSSQSLVYSH GNTYLH | 672 | RVSNRF S | 624 | FQSTHL PYT | 626 |
| NOV589 | RSSQSLVRSD GTTYFN | 669 | RVSNRF S | 624 | LQSSHF PWT | 680 |
| NOV580 | KTSQNIDKYLN | 673 | NTNNLE AGVP | 754 | LQHRSS YT | 682 |
| NOV567 | RGSQSIGNSL N | 674 | STSTLEY GVP | 755 | LQYATY PYT | 683 |
| NOV221 | KSSQNIDKYLN | 675 | NTNNLE AGVP | 754 | LQHRS GYT | 684 |
| CD3_sp11a_bkm1 | RSSQSLVRSD GTTYFN | 669 | RVSNRF S | 624 | LQSSHF PWT | 680 |
| CD3_SP11a_bkm2 | RSSQSLVRSD GTTYFN | 669 | RVSNRF S | 624 | LQSSHF PWT | 680 |

TABLE AH-2-continued

CD3 Binders-Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_hz0 | RSSQSLVRSD GTTYFN | 669 | RVSNRF S | 624 | LQSSHF PWT | 680 |
| CD3_SP11A_HZ1 | RSSQSLVRSD GTTYFN | 669 | RVSNRF S | 624 | LQSSH | 685 |
| CD3_sp11a_sansPTM_ hz1 | RSSQSLVRSE GTTYFN | 676 | RVSNRF S | 624 | LQSSHF PWT | 680 |
| CD3_sp11a_sansPTM_ rat | RSSQSLVRSE GTTYFN | 676 | RVSNRF S | 624 | LQSSHF PWT | 680 |
| CD3_sp11a_VHVL_YY | RSSQSLVRSD GTTYFN | 669 | RVSNRF S | 624 | LQSSHF PWT | 680 |
| CD3_SP11A_VHVL_SS | RSSQSLVRSD GTTYFN | 669 | RVSNRF S | 624 | LQSSHF PWT | 680 |
| CD3_SP11A_VHVL_WS | RSSQSLVRSD GTTYFN | 669 | RVSNRF S | 624 | LQSSHF PWT | 680 |
| CD3_sp11a_VHVL_SW | RSSQSLVRSD GTTYFN | 669 | RVSNRF S | 624 | LQSSHF PWT | 680 |
| CD3_SP11A_VHVL_TT | RSSQSLVRSD GTTYFN | 669 | RVSNRF S | 624 | LQSSHF PWT | 680 |
| CD3_SP11A_VHVL_TW | RSSQSLVRSD GTTYFN | 669 | RVSNRF S | 624 | LQSSHF PWT | 680 |
| CD3_SP11A_VHVL_WT | RSSQSLVRSD GTTYFN | 669 | RVSNRF S | 624 | LQSSHF PWT | 680 |
| CD3_SP11A_VH3_VLK_3 | RSSQSLVRSE GTTYFN | 676 | RVSNRF S | 624 | LQSSHF PWT | 680 |
| CD3_sp11a_VH1_VK2 | RSSQSLVRSD GTTYFN | 669 | RVSNRF S | 624 | LQSSHF PWT | 680 |
| CD3_SP11A_VH3_VLK1 | RSSQSLVRSE GTTYFN | 676 | RVSNRF S | 624 | LQSSHF PWT | 680 |
| CD3_SP11A_VH5_VK2 | RSSQSLVRSD GTTYFN | 669 | RVSNRF S | 624 | LQSSHF PWT | 680 |
| CD3_sp9aFW1_VL_VH_ S56G | KASQNINNYLN | 671 | NTDHLQ AGVP | 753 | LQHRSR YT | 681 |
| CD3_SP9AFW4_VL_VH_ S56G | KASQNINNYLN | 671 | NTDHLQ AGVP | 753 | LQHRSR YT | 681 |
| CD3_sp9aFW1_VLVH | KASQNINNYLN | 671 | NTDHLQ AGVP | 753 | LQHRSR YT | 681 |
| CD3_sp9aFW4_VLVH | KASQNINNYLN | 671 | NTDHLQ AGVP | 753 | LQHRSR YT | 681 |
| CD3_sp9arabtor_VHVL | KASQNINNYLN | 671 | NTDHLQ AGVP | 753 | LQHRSR YT | 681 |
| CD3_sp9arabtor_VLVH | KASQNINNYLN | 671 | NTDHLQ AGVP | 753 | LQHRSR YT | 681 |
| CD3_SP11AVH3_VLK_ 3_Y | RSSQSLVRSE GTTYFN | 676 | RVSNRF S | 624 | LQSSHF PWT | 680 |
| CD3_SP11AVH3_VLK_ 3_S | RSSQSLVRSE GTTYFN | 676 | RVSNRF S | 624 | LQSSHF PWT | 680 |
| CD3_SP11AVH3_VLK_ 3_Y_PTM | RSSQSLVRSD GTTYFN | 669 | RVSNRF S | 624 | LQSSHF PWT | 680 |
| CD3_SP11AVH3_VLK_ 3_S_PTM | RSSQSLVRSD GTTYFN | 669 | RVSNRF S | 624 | LQSSHF PWT | 680 |

TABLE AH-2-continued

CD3 Binders-Light Chain CDR sequences according to combination of Kabat and IMGT
numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11AVH3_VLK_3_Y_SW | RSSQSLVRSE GTTYFN | 676 | RVSNRF S | 624 | LQSSHF PWT | 680 |
| CD3_SP11AVH3_VLK_3_S_SW | RSSQSLVRSE GTTYFN | 676 | RVSNRF S | 624 | LQSSHF PWT | 680 |
| CD3_SP11AVH3_VLK_3_Y_PTM_SW | RSSQSLVRSD GTTYFN | 669 | RVSNRF S | 624 | LQSSHF PWT | 680 |
| CD3_SP11AVH3_VLK_3_S_SWPTM | RSSQSLVRSD GTTYFN | 669 | RVSNRF S | 624 | LQSSHF PWT | 680 |
| CD3_SP11AVH3_VLK_SWPTM | RSSQSLVRSD GTTYFN | 669 | RVSNRF S | 624 | LQSSHF PWT | 680 |
| CD3_SP11AVH3_VLK_3_SW | RSSQSLVRSE GTTYFN | 676 | RVSNRF S | 624 | LQSSHF PWT | 680 |
| CD3_sp11a_VH1_VK2_Y | RSSQSLVRSD GTTYFN | 669 | RVSNRF S | 624 | LQSSHF PWT | 680 |
| CD3_sp11a_VH1_VK2_S | RSSQSLVRSD GTTYFN | 669 | RVSNRF S | 624 | LQSSHF PWT | 680 |
| CD3_sp11a_VH1_VK2_Y_PTM | RSSQSLVRSE GTTYFN | 676 | RVSNRF S | 624 | LQSSHF PWT | 680 |
| CD3_sp11a_VH1_VK2_S_PTM | RSSQSLVRSE GTTYFN | 676 | RVSNRF S | 624 | LQSSHF PWT | 680 |
| CD3_sp11a_VH1_VK2_Y_SW | RSSQSLVRSD GTTYFN | 669 | RVSNRF S | 624 | LQSSHF PWT | 680 |
| CD3_sp11a_VH1_VK2_S_SW | RSSQSLVRSD GTTYFN | 669 | RVSNRF S | 624 | LQSSHF PWT | 680 |
| CD3_sp11a_VH1_VK2_Y_PTM | RSSQSLVRSE GTTYFN | 676 | RVSNRF S | 624 | LQSSHF PWT | 680 |
| CD3_sp11a_VH1_VK2_S_PTM_SW | RSSQSLVRSE GTTYFN | 676 | RVSNRF S | 624 | LQSSHF PWT | 680 |
| CD3_sp11a_VH1_VK2_SW | RSSQSLVRSD GTTYFN | 669 | RVSNRF S | 624 | LQSSHF PWT | 680 |
| CD3_sp11a_VH1_VK2_SW_PTM | RSSQSLVRSE GTTYFN | 676 | RVSNRF S | 624 | LQSSHF PWT | 680 |
| CD3_SP11A_VH3_VLK1_Y | RSSQSLVRSE GTTYFN | 676 | RVSNRF S | 624 | LQSHF PWT | 680 |
| CD3_SP11A_VH3_VLK1_S | RSSQSLVRSE GTTYFN | 676 | RVSNRF S | 624 | LQSSHF PWT | 680 |
| CD3_SP11A_VH3_VLK1_Y_PTM | RSSQSLVRSD GTTYFN | 669 | RVSNRF S | 624 | LQSSHF PWT | 680 |
| CD3_SP11A_VH3_VLK1_S_PTM | RSSQSLVRSD GTTYFN | 669 | RVSNRF S | 624 | LQSSHF PWT | 680 |
| CD3_SP11A_VH3_VLK1_Y_SW | RSSQSLVRSE GTTYFN | 676 | RVSNRF S | 624 | LQSSHF PWT | 680 |
| CD3_SP11A_VH3_VLK1_S_SW | RSSQSLVRSE GTTYFN | 676 | RVSNRF S | 624 | LQSSHF PWT | 680 |
| CD3_SP11A_VH3_VLK1_Y_PTM | RSSQSLVRSD GTTYFN | 669 | RVSNRF S | 624 | LQSSHF PWT | 680 |
| CD3_SP11A_VH3_VLK1_S_PTM_SW | RSSQSLVRSD GTTYFN | 669 | RVSNRF S | 624 | LQSSHF PWT | 680 |

TABLE AH-2-continued

CD3 Binders-Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH3_VLK1_ PTM_SW | RSSQSLVRSD GTTYFN | 669 | RVSNRF S | 624 | LQSSHF PWT | 680 |
| CD3_SP11A_VH3_VLK1_ SW | RSSQSLVRSE GTTYFN | 676 | RVSNRF S | 624 | LQSSHF PWT | 680 |
| CD3_SP11A_VH5_VK2_ Y | RSSQSLVRSD GTTYFN | 669 | RVSNRF S | 624 | LQSSHF PWT | 680 |
| CD3_SP11A_VH5_VK2_ S | RSSQSLVRSD GTTYFN | 669 | RVSNRF S | 624 | LQSSHF PWT | 680 |
| CD3_SP11A_VH5_VK2_ Y_PTM | RSSQSLVRSD GTTYFN | 669 | RVSNRF S | 624 | LQSSHF PWT | 680 |
| CD3_SP11A_VH5_VK2_ S_PTM | RSSQSLVRSD GTTYFN | 669 | RVSNRF S | 624 | LQSSHF PWT | 680 |
| CD3_SP11A_VH5_VK2_ Y_SW | RSSQSLVRSD GTTYFN | 669 | RVSNRF S | 624 | LQSSHF PWT | 680 |
| CD3_SP11A_VH5_VK2_ S_SW | RSSQSLVRSD GTTYFN | 669 | RVSNRF S | 624 | LQSSHF PWT | 680 |
| CD3_SP11A_VH5_VK2_ Y_PTM_SW | RSSQSLVRSD GTTYFN | 669 | RVSNRF S | 624 | LQSSHF PWT | 680 |
| CD3_SP11A_VH5_VK2_ S_PTM_SW | RSSQSLVRSD GTTYFN | 669 | RVSNRF S | 624 | LQSSHF PWT | 680 |
| CD3_SP11A_VH5_VK2_ PTM_SW | RSSQSLVRSD GTTYFN | 669 | RVSNRF S | 624 | LQSSHF PWT | 680 |
| CD3_SP11A_VH5_VK2_ SW | RSSQSLVRSD GTTYFN | 669 | RVSNRF S | 624 | LQSSHF PWT | 680 |

TABLE AI-1

CD3 Binders-Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV292 | GFTFS KNG | 708 | YYDS SK | 689 | ASFWWDLDFDH | 715 |
| NOV123 | GYTFT SYY | 614 | YPGH DA | 690 | VRPNTMMAPLA Y | 716 |
| Sp10b | GYTFT SYY | 614 | YPGH DA | 690 | VRPNTMMAPLA Y | 716 |
| NOV453 | GFSLTT YN | 597 | RYSG D | 601 | TSDPMYIPNYSY GVMNA | 717 |
| NOV229 | GFSLTT YN | 597 | RYSG D | 601 | ARDPMYIPNYSY GVMNA | 718 |
| NOV110 | GYTFT SYY | 614 | YPAN GG | 691 | ARPVTMMAPLVF | 719 |
| NOV832 | GYTFT SYY | 614 | YPAN GG | 691 | ARPVTMMAPLVF | 719 |
| NOV589 | GFTFS KNG | 708 | YYDS SR | 692 | ASFWWDLDFDY | 720 |
| NOV580 | GFSLTT YN | 597 | RYSG D | 601 | TRDPMYIPGYSY GVMNA | 721 |

TABLE AI-1-continued

CD3 Binders-Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV567 | GFAFR KYG | 709 | YYDS SK | 689 | AALNSEYD | 582 |
| NOV221 | GFSLTT YN | 597 | RYSG D | 601 | TRDPMYIPGYSY GVMNA | 721 |
| CD3_sp11a_bkm1 | GFTFS KNG | 708 | YYDS SK | 689 | ASFWWDLDFDH | 715 |
| CD3_SP11a_bkm2 | GFTFS KNG | 708 | YYDS SK | 689 | AKFWWDLDFDH | 722 |
| CD3_sp11a_hz0 | GFTFS KNG | 708 | YYDS SK | 689 | AKFWWDLDFDH | 722 |
| CD3_SP11A_HZ1 | GFTFS KNG | 708 | YYDS SK | 689 | ASFWWDLDFDH | 715 |
| CD3_sp11a_sansPTM_ hz1 | GFTFS KQG | 710 | YYDS SK | 689 | ASFWWDLDFDH | 715 |
| CD3_sp11a_sansPTM_ rat | GFTFS KQG | 710 | YYDS SK | 689 | ASFWWDLDFDH | 715 |
| CD3_sp11a_VHVL_YY | GFTFS KNG | 708 | YYDS SK | 689 | ASFYYDLDFDH | 723 |
| CD3_SP11A_VHVL_SS | GFTFS KNG | 708 | YYDS SK | 689 | ASFSSDLDFDH | 724 |
| CD3_SP11A_VHVL_WS | GFTFS KNG | 708 | YYDS SK | 689 | ASFWSDLDFDH | 725 |
| CD3_sp11a_VHVL_SW | GFTFS KNG | 708 | YYDS SK | 689 | ASFSWDLDFDH | 726 |
| CD3_SP11A_VHVL_TT | GFTFS KNG | 708 | YYDS SK | 689 | ASFTTDLDFDH | 727 |
| CD3_SP11A_VHVL_TW | GFTFS KNG | 708 | YYDS SK | 689 | ASFTWDLDFDH | 728 |
| CD3_SP11A_VHVL_WT | GFTFS KNG | 708 | YYDS SK | 689 | ASFWTDLDFDH | 729 |
| CD3_SP11A_VH3_VLK_3 | GFTFS KNG | 708 | YYDS SK | 689 | ASFWWDLDFDH | 715 |
| CD3_sp11a_VH1_VK2 | GFTFS KQG | 710 | YYDS SK | 689 | ASFWWDLDFDH | 715 |
| CD3_SP11A_VH3_VLK1 | GFTFS KNG | 708 | YYDS SK | 689 | ASFWWDLDFDH | 715 |
| CD3_SP11A_VH5_VK2 | GFTFS KQG | 710 | YYDS SK | 689 | ASFWWDLDFDH | 715 |
| CD3_sp9aFW1_VL_VH_ S56G | GFSLTT YN | 597 | RYSG D | 601 | ASDPMYIPNYAY GVMNA | 730 |
| CD3_SP9AFW4_VL_VH_ S56G | GFSLTT YN | 597 | RYSG D | 601 | ASDPMYIPNYAY GVMNA | 730 |
| CD3_sp9aFW1_VLVH | GFSLTT YN | 597 | RYSG D | 601 | ASDPMYIPNYAY GVMNA | 730 |
| CD3_sp9aFW4_VLVH | GFSLTT YN | 597 | RYSG D | 601 | ASDPMYIPNYAY GVMNA | 730 |
| CD3_sp9arabtor_VHVL | GFSLTT YN | 597 | RYSG D | 601 | ASDPMYIPNYAY GVMNA | 730 |
| CD3_sp9arabtor_VLVH | GFSLTT YN | 597 | RYSG D | 601 | ASDPMYIPNYAY GVMNA | 730 |

TABLE AI-1-continued

CD3 Binders-Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11AVH3_VLK_3_Y | GFTFS KNG | 708 | YYDS SK | 689 | ASYWWDLDFDH | 743 |
| CD3_SP11AVH3_VLK_3_S | GFTFS KNG | 708 | YYDS SK | 689 | ASSWWDLDFDH | 744 |
| CD3_SP11AVH3_VLK_3_Y_PTM | GFTFS KNG | 708 | YYDS SK | 689 | ASYWWDLDFDH | 743 |
| CD3_SP11AVH3_VLK_3_S_PTM | GFTFS KNG | 708 | YYDS SK | 689 | ASSWWDLDFDH | 744 |
| CD3_SP11AVH3_VLK_3_Y_SW | GFTFS KNG | 708 | YYDS SK | 689 | ASYSWDLDFDH | 737 |
| CD3_SP11AVH3_VLK_3_S_SW | GFTFS KNG | 708 | YYDS SK | 689 | ASSSWDLDFDH | 738 |
| CD3_SP11AVH3_VLK_3_Y_PTM_SW | GFTFS KNG | 708 | YYDS SK | 689 | ASYSWDLDFDH | 737 |
| CD3_SP11AVH3_VLK_3_S_SWPTM | GFTFS KNG | 708 | YYDS SK | 689 | ASSSWDLDFDH | 738 |
| CD3_SP11AVH3_VLK_S WPTM | GFTFS KNG | 708 | YYDS SK | 689 | ASFSWDLDFDH | 726 |
| CD3_SP11AVH3_VLK_3_SW | GFTFS KNG | 708 | YYDS SK | 689 | ASFSWDLDFDH | 726 |
| CD3_sp11a_VH1_VK2_Y | GFTFS KQG | 710 | YYDS SK | 689 | ASYWWDLDFDH | 743 |
| CD3_sp11a_VH1_VK2_S | GFTFS KQG | 710 | YYDS SK | 689 | ASSWWDLDFDH | 744 |
| CD3_sp11a_VH1_VK2_Y_PTM | GFTFS KNG | 708 | YYDS SK | 689 | ASYWWDLDFDH | 743 |
| CD3_sp11a_VH1_VK2_S_PTM | GFTFS KNG | 708 | YYDS SK | 689 | ASSWWDLDFDH | 744 |
| CD3_sp11a_VH1_VK2_Y_sw | GFTFS KQG | 710 | YYDS SK | 689 | ASYSWDLDFDH | 737 |
| CD3_sp11a_VH1_VK2_S_SW | GFTFS KQG | 710 | YYDS SK | 689 | ASSSWDLDFDH | 738 |
| CD3_sp11a_VH1_VK2_Y_PTM | GFTFS KNG | 708 | YYDS SK | 689 | ASYSWDLDFDH | 737 |
| CD3_sp11a_VH1_VK2_S_PTM_SW | GFTFS KNG | 708 | YYDS SK | 689 | ASSSWDLDFDH | 738 |
| CD3_sp11a_VH1_VK2_SW | GFTFS KQG | 710 | YYDS SK | 689 | ASFSWDLDFDH | 726 |
| CD3_sp11a_VH1_VK2_SW_PTM | GFTFS KNG | 708 | YYDS SK | 689 | ASFSWDLDFDH | 726 |
| CD3_SP11A_VH3_VLK1_Y | GFTFS KNG | 708 | YYDS SK | 689 | ASYWWDLDFDH | 743 |
| CD3_SP11A_VH3_VLK1_S | GFTFS KNG | 708 | YYDS SK | 689 | ASSWWDLDFDH | 744 |
| CD3_SP11A_VH3_VLK1_Y_PTM | GFTFS KQG | 710 | YYDS SK | 689 | ASYWWDLDFDH | 743 |
| CD3_SP11A_VH3_VLK1_S_PTM | GFTFS KQG | 710 | YYDS SK | 689 | ASSWWDLDFDH | 744 |

TABLE AI-1-continued

CD3 Binders-Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VH3_VLK1_Y_SW | GFTFS KNG | 708 | YYDS SK | 689 | ASYSWDLDFDH | 737 |
| CD3_SP11A_VH3_VLK1_S_SW | GFTFS KNG | 708 | YYDS SK | 689 | ASSSWDLDFDH | 738 |
| CD3_SP11A_VH3_VLK1_Y_PTM | GFTFS KQG | 710 | YYDS SK | 689 | ASYWWDLDFDH | 743 |
| CD3_SP11A_VH3_VLK1_S_PTM_SW | GFTFS KQG | 710 | YYDS SK | 689 | ASSSWDLDFDH | 738 |
| CD3_SP11A_VH3_VLK1_PTM_SW | GFTFS KQG | 710 | YYDS SK | 689 | ASFSWDLDFDH | 726 |
| CD3_SP11A_VH3_VLK1_SW | GFTFS KNG | 708 | YYDS SK | 689 | ASFSWDLDFDH | 726 |
| CD3_SP11A_VH5_VK2_Y | GFTFS KQG | 710 | YYDS SK | 689 | ASYWWDLDFDH | 743 |
| CD3_SP11A_VH5_VK2_S | GFTFS KQG | 710 | YYDS SK | 689 | ASSWWDLDFDH | 744 |
| CD3_SP11A_VH5_VK2_Y_PTM | GFTFS KNG | 708 | YYDS SK | 689 | ASYWWDLDFDH | 743 |
| CD3_SP11A_VH5_VK2_S_PTM | GFTFS KNG | 708 | YYDS SK | 689 | ASSWWDLDFDH | 744 |
| CD3_SP11A_VH5_VK2_Y_SW | GFTFS KQG | 710 | YYDS SK | 689 | ASYSWDLDFDH | 737 |
| CD3_SP11A_VH5_VK2_S_SW | GFTFS KQG | 710 | YYDS SK | 689 | ASSSWDLDFDH | 738 |
| CD3_SP11A_VH5_VK2_Y_PTM_SW | GFTFS KNG | 708 | YYDS SK | 689 | ASYSWDLDFDH | 737 |
| CD3_SP11A_VH5_VK2_S_PTM_SW | GFTFS KNG | 708 | YYDS SK | 689 | ASSSWDLDFDH | 738 |
| CD3_SP11A_VH5_VK2_PTM_SW | GFTFS KNG | 708 | YYDS SK | 689 | ASFSWDLDFDH | 726 |
| CD3_SP11A_VH5_VK2_SW | GFTFS KQG | 710 | YYDS SK | 689 | ASFSWDLDFDH | 726 |

TABLE AI-2

CD3 Binders-Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| NOV292 | SQSLVRSD GTTY | 693 | RVS | 625 | LQSSHF PWT | 680 |
| NOV123 | SQSLIYSIG NTY | 694 | RVS | 625 | FQSTHL PYT | 626 |
| Sp10b | SQSLIYSIG NTY | 694 | RVS | 625 | FQSTHL PYT | 626 |
| NOV453 | SQNINNY | 695 | NTDHLQA GVP | 753 | LQHRSR YT | 681 |
| NOV229 | SQNINNY | 695 | NTDHLQA GVP | 753 | LQHRSR YT | 681 |

TABLE AI-2-continued

CD3 Binders-Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| NOV110 | SQSLVYSH GNTY | 696 | RVS | 625 | FQSTHL PYT | 626 |
| NOV832 | SQSLVYSH GNTY | 696 | RVS | 625 | FQSTHL PYT | 626 |
| NOV589 | SQSLVRSD GTTY | 693 | RVS | 625 | LQSSHF PWT | 680 |
| NOV580 | SQNIDKY | 697 | NTNNLEA GVP | 754 | LQHRSS YT | 682 |
| NOV567 | SQSIGNS | 698 | STSTLEY GVP | 755 | LQYATY PYT | 683 |
| NOV221 | SQNIDKY | 697 | NTNNLEA GVP | 754 | LQHRSG YT | 684 |
| CD3_sp11a_bkm1 | SQSLVRSD GTTY | 693 | RVS | 625 | LQSSHF PWT | 680 |
| CD3_SP11a_bkm2 | SQSLVRSD GTTY | 693 | RVS | 625 | LQSSHF PWT | 680 |
| CD3_sp11a_hz0 | SQSLVRSD GTTY | 693 | RVS | 625 | LQSSHF PWT | 680 |
| CD3_SP11A_HZ1 | SQSLVRSD GTTY | 693 | RVS | 625 | LQSSHF PW | 761 |
| CD3_sp11a_sansPTM_hz1 | SQSLVRSE GTTY | 699 | RVS | 625 | LQSSHF PWT | 680 |
| CD3_sp11a_sansPTM_rat | SQSLVRSE GTTY | 699 | RVS | 625 | LQSSHF PWT | 680 |
| CD3_sp11a_VHVL_YY | SQSLVRSD GTTY | 693 | RVS | 625 | LQSSHF PWT | 680 |
| CD3_SP11A_VHVL_SS | SQSLVRSD GTTY | 693 | RVS | 625 | LQSSHF PWT | 680 |
| CD3_SP11A_VHVL_WS | SQSLVRSD GTTY | 693 | RVS | 625 | LQSSHF PWT | 680 |
| CD3_sp11a_VHVL_SW | SQSLVRSD GTTY | 693 | RVS | 625 | LQSSHF PWT | 680 |
| CD3_SP11A_VHVL_TT | SQSLVRSD GTTY | 693 | RVS | 625 | LQSSHF PWT | 680 |
| CD3_SP11A_VHVL_TW | SQSLVRSD GTTY | 693 | RVS | 625 | LQSSHF PWT | 680 |
| CD3_SP11A_VHVL_WT | SQSLVRSD GTTY | 693 | RVS | 625 | LQSSHF PWT | 680 |
| CD3_SP11A_VH3_VLK_3 | SQSLVRSE GTTY | 699 | RVS | 625 | LQSSHF PWT | 680 |
| CD3_sp11a_VH1_VK2 | SQSLVRSD GTTY | 693 | RVS | 625 | LQSSHF PWT | 680 |
| CD3_SP11A_VH3_VLK1 | SQSLVRSE GTTY | 699 | RVS | 625 | LQSSHF PWT | 680 |
| CD3_SP11A_VH5_VK2 | SQSLVRSD GTTY | 693 | RVS | 625 | LQSSHF PWT | 680 |
| CD3_sp9aFW1_VL_VH_S56G | SQNINNY | 695 | NTDHLQA GVP | 753 | LQHRSR YT | 681 |
| CD3_SP9AFW4_VL_VH_S56G | SQNINNY | 695 | NTDHLQA GVP | 753 | LQHRSR YT | 681 |

TABLE AI-2-continued

CD3 Binders-Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp9aFW1_VLVH | SQNINNY | 695 | NTDHLQAGVP | 753 | LQHRSRYT | 681 |
| CD3_sp9aFW4_VLVH | SQNINNY | 695 | NTDHLQAGVP | 753 | LQHRSRYT | 681 |
| CD3_sp9arabtor_VHVL | SQNINNY | 695 | NTDHLQAGVP | 753 | LQHRSRYT | 681 |
| CD3_sp9arabtor_VLVH | SQNINNY | 695 | NTDHLQAGVP | 753 | LQHRSRYT | 681 |
| CD3_SP11AVH3_VLK_3_Y | SQSLVRSEGTTY | 699 | RVS | 625 | LQSSHFPWT | 680 |
| CD3_SP11AVH3_VLK_3_S | SQSLVRSEGTTY | 699 | RVS | 625 | LQSSHFPWT | 680 |
| CD3_SP11AVH3_VLK_3_Y_PTM | SQSLVRSDGTTY | 693 | RVS | 625 | LQSSHFPWT | 680 |
| CD3_SP11AVH3_VLK_3_S_PTM | SQSLVRSDGTTY | 693 | RVS | 625 | LQSSHFPWT | 680 |
| CD3_SP11AVH3_VLK_3_Y_SW | SQSLVRSEGTTY | 699 | RVS | 625 | LQSSHFPWT | 680 |
| CD3_SP11AVH3_VLK_3_S_SW | SQSLVRSEGTTY | 699 | RVS | 625 | LQSSHFPWT | 680 |
| CD3_SP11AVH3_VLK_3_Y_PTM_SW | SQSLVRSDGTTY | 693 | RVS | 625 | LQSSHFPWT | 680 |
| CD3_SP11AVH3_VLK_3_S_SWPTM | SQSLVRSDGTTY | 693 | RVS | 625 | LQSSHFPWT | 680 |
| CD3_SP11AVH3_VLK_SWPTM | SQSLVRSDGTTY | 693 | RVS | 625 | LQSSHFPWT | 680 |
| CD3_SP11AVH3_VLK_3_SW | SQSLVRSEGTTY | 699 | RVS | 625 | LQSSHFPWT | 680 |
| CD3_sp11a_VH1_VK2_Y | SQSLVRSDGTTY | 693 | RVS | 625 | LQSSHFPWT | 680 |
| CD3_sp11a_VH1_VK2_S | SQSLVRSDGTTY | 693 | RVS | 625 | LQSSHFPWT | 680 |
| CD3_sp11a_VH1_VK2_Y_PTM | SQSLVRSEGTTY | 699 | RVS | 625 | LQSSHFPWT | 680 |
| CD3_sp11a_VH1_VK2_S_PTM | SQSLVRSEGTTY | 699 | RVS | 625 | LQSSHFPWT | 680 |
| CD3_sp11a_VH1_VK2_Y_SW | SQSLVRSDGTTY | 693 | RVS | 625 | LQSSHFPWT | 680 |
| CD3_sp11a_VH1_VK2_S_SW | SQSLVRSDGTTY | 693 | RVS | 625 | LQSSHFPWT | 680 |
| CD3_sp11a_VH1_VK2_Y_PTM | SQSLVRSEGTTY | 699 | RVS | 625 | LQSSHFPWT | 680 |
| CD3_sp11a_VH1_VK2_S_PTM_SW | SQSLVRSEGTTY | 699 | RVS | 625 | LQSSHFPWT | 680 |
| CD3_sp11a_VH1_VK2_SW | SQSLVRSDGTTY | 693 | RVS | 625 | LQSSHFPWT | 680 |
| CD3_sp11a_VH1_VK2_SW_PTM | SQSLVRSEGTTY | 699 | RVS | 625 | LQSSHFPWT | 680 |

TABLE AI-2-continued

CD3 Binders-Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH3_VLK1_Y | SQSLVRSE GTTY | 699 | RVS | 625 | LQSSHF PWT | 680 |
| CD3_SP11A_VH3_VLK1_S | SQSLVRSE GTTY | 699 | RVS | 625 | LQSSHF PWT | 680 |
| CD3_SP11A_VH3_VLK1_Y_PTM | SQSLVRSD GTTY | 693 | RVS | 625 | LQSSHF PWT | 680 |
| CD3_SP11A_VH3_VLK1_S_PTM | SQSLVRSD GTTY | 693 | RVS | 625 | LQSSHF PWT | 680 |
| CD3_SP11A_VH3_VLK1_Y_SW | SQSLVRSE GTTY | 699 | RVS | 625 | LQSSHF PWT | 680 |
| CD3_SP11A_VH3_VLK1_S_SW | SQSLVRSE GTTY | 699 | RVS | 625 | LQSSHF PWT | 680 |
| CD3_SP11A_VH3_VLK1_Y_PTM | SQSLVRSD GTTY | 693 | RVS | 625 | LQSSHF PWT | 680 |
| CD3_SP11A_VH3_VLK1_S_PTM_SW | SQSLVRSD GTTY | 693 | RVS | 625 | LQSSHF PWT | 680 |
| CD3_SP11A_VH3_VLK1P TM_SW | SQSLVRSD GTTY | 693 | RVS | 625 | LQSSHF PWT | 680 |
| CD3_SP11A_VH3_VLK1_SW | SQSLVRSE GTTY | 699 | RVS | 625 | LQSSHF PWT | 680 |
| CD3_SP11A_VH5_VK2_Y | SQSLVRSD GTTY | 693 | RVS | 625 | LQSSHF PWT | 680 |
| CD3_SP11A_VH5_VK2_S | SQSLVRSD GTTY | 693 | RVS | 625 | LQSSHF PWT | 680 |
| CD3_SP11A_VH5_VK2_Y_PTM | SQSLVRSD GTTY | 693 | RVS | 625 | LQSSHF PWT | 680 |
| CD3_SP11A_VH5_VK2_S_PTM | SQSLVRSD GTTY | 693 | RVS | 625 | LQSSHF PWT | 680 |
| CD3_SP11A_VH5_VK2_Y_SW | SQSLVRSD GTTY | 693 | RVS | 625 | LQSSHF PWT | 680 |
| CD3_SP11A_VH5_VK2_S_SW | SQSLVRSD GTTY | 693 | RVS | 625 | LQSSHF PWT | 680 |
| CD3_SP11A_VH5_VK2_Y_PTM_SW | SQSLVRSD GTTY | 693 | RVS | 625 | LQSSHF PWT | 680 |
| CD3_SP11A_VH5_VK2_S_PTM_SW | SQSLVRSD GTTY | 693 | RVS | 625 | LQSSHF PWT | 680 |
| CD3_SP11A_VH5_VK2_PTM_SW | SQSLVRSD GTTY | 693 | RVS | 625 | LQSSHF PWT | 680 |
| CD3_SP11A_VH5_VK2_SW | SQSLVRSD GTTY | 693 | RVS | 625 | LQSSHF PWT | 680 |

TABLE AJ-1

CD3 Binders-Heavy chain variable sequences

| Binder | Sequence | SEQ ID NO: |
|---|---|---|
| NOV292 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFVWVDLDFDHWGQGTMVTVSS | 762 |

TABLE AJ-1-continued

| Binder | Sequence | SEQ ID NO: |
|---|---|---|
| NOV123 | QVQLVQSGAEVKKPGASVKVSCKASGYTFTSYYIYWVRQAPG QRLEWMGYIYPGHDAIYYSENFKGRVTITADTSASTAYMELSS LRSEDTAVYYCVRPNTMMAPLAYWGQGTLVTVSS | 763 |
| Sp10b | QVQLHQSGAELAKPGTSVNLSCKASGYTFTSYYIYWIKRRPG QGLEWIGYIYPGHDAIYYSENFKGKATFTADTSSSTAYMLLGS LTPEDSAYYFCVRPNTMMAPLAYWGQGTLVTVSS | 764 |
| NOV453 | QVQLQESGPGLVKPSETLSLTCTVSGFSLTTYNVHWIRQPPG KGLEWIGRMRYSGDTSFNAALTSRVTISRDTSKNQVSLKLSSV TAADTAVYYCTSDPMYIPNYSYGVMNAWGQGTTVTVSS | 765 |
| NOV229 | QVQLQESGPGLVKPSETLSLTCTVSGFSLTTYNVHWIRQPPG KGLEWIGRMRYSGDTSFNAALTSRVTISVDTSKNQFSLKLSSV TAADTAVYYCARDPMYIPNYSYGVMNAWGQGTTVTVSS | 766 |
| NOV110 | QVQLVQSGAEVKKPGASVKVSCKASGYTFTSYYIYWVRQAPG QRLEWMGYIYPANGGIYYSEKFKGRVTITADTSAGTAYMELSS LRSEDTAVYYCARPVTMMAPLVFWGQGTLVTVSS | 767 |
| NOV832 | QVQLVQSGAEVKKPGASVKVSCKASGYTFTSYYIYWVRQAPG QRLEWMGYIYPANGGIYYSEKFKGRVTITRDTSASTAYMELSS LRSEDTAVYYCARPVTMMAPLVFWGQGTLVTVSS | 768 |
| NOV589 | QVQLVESGGGVVQPGRSLRLSCAASGFTFSKNGMHWVRQA PGKGLEWVAMIYYDSSRMYYADTVKGRFTISRDNSKNTLYLQ MNSLRAEDTAVYYCASFWWDLDFDYWGQGTMVTVSS | 769 |
| NOV580 | QVQLQESGPGLVKPSETLSLTCTVSGFSLTTYNIHWIRQPPGK GLEWIGRMRYSGDTSYSSALKSRVTISRDTSKNQVSLKLSSVT AADTAVYYCTRDPMYIPGYSYGVMNAWGQGTTVTVSS | 770 |
| NOV567 | QVQLVESGGGVVQPGRSLRLSCAASGFAFRKYGMSWVRQA PGKGLEWVALIYYDSSKMNYADTVKGRFTISRDNSKNTLYLQ MNSLRAEDTAVYYCAALNSEYDWGQGTMVTVSS | 771 |
| NOV221 | QVQLQESGPGLVKPSETLSLTCTVSGFSLTTYNIHWIRQPPGK GLEWIGRMRYSGDTSYSSALKSRVTISRDTSKNQVSLKLSSVT AADTAVYYCTRDPMYIPGYSYGVMNAWGQGTTVTVSS | 770 |
| CD3_sp11a_bkm1 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWWDLDFDHWGQGTMVTVSS | 762 |
| CD3_SP11a_bkm2 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCAKFWWDLDFDHWGQGTMVTVSS | 772 |
| CD3_sp11a_hz0 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCAKFWWDLDFDHWGQGTMVTVSS | 772 |
| CD3_SP11A_HZ1 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFVWVDLDFDHWGQGTMVTVSS | 762 |
| CD3_sp11a_sansPTM_ hz1 | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFVWVDLDFDHWGQGTMVTVSS | 773 |
| CD3_sp11a_sansPTM_ rat | EVKLVESGGDLVQPGDSLTLSCVASGFTFSKQGMHWIRQAPK KGLEWIAMIYYDSSKMYYADTVKGRFTISRDNSKNTLYLEMNS LRSEDTAMYYCASFVWVDLDFDHWGQGVMVTVSS | 774 |
| CD3_sp11a_VHVL_YY | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFYYDLDFDHWGQGTMVTVSS | 775 |
| CD3_SP11A_VHVL_SS | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSSDLDFDHWGQGTMVTVSS | 776 |
| CD3_SP11A_VHVL_WS | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWSDLDFDHWGQGTMVTVSS | 777 |

TABLE AJ-1-continued

| Binder | Sequence | SEQ ID NO: |
|---|---|---|
| CD3_sp11a_VHVL_SW | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFSWDLDFDHWGQGTMVTVSS | 778 |
| CD3_SP11A_VHVL_TT | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFTTDLDFDHWGQGTMVTVSS | 779 |
| CD3_SP11A_VHVL_TW | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFTWDLDFDHWGQGTMVTVSS | 780 |
| CD3_SP11A_VHVL_WT | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFWTDLDFDHWGQGTMVTVSS | 781 |
| CD3_SP11A_VH3_VLK_3 | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFWWDLDFDHWGQGTMVTVSS | 762 |
| CD3_sp11a_VH1_VK2 | QVQLVQSGAEVKKPGASVKVSCKASGFTFSKQGMHWVRQA<br>PGQGLEWMGMIYYDSSKMYYADTVKGRVTMTRDTSTNTLYM<br>ELSSLRSEDTAVYYCASFWWDLDFDHWGQGTMVTVSS | 782 |
| CD3_SP11A_VH3_VLK1 | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASFWWDLDFDHWGQGTMVTVSS | 762 |
| CD3_SP11A_VH5_VK2 | EVQLVQSGAEVKKPGESLKISCKGSGFTFSKQGMHWVRQMP<br>GKGLEWMGMIYYDSSKMYYADTVKGQVTISRDNSINTLYLQW<br>SSLKASDTAMYYCASFVWVDLDFDHWGQGTMVTVSS | 783 |
| CD3_sp9aFW1_VL_VH_S56G | EVQLVESGGGLVQPGGSLRLSCAASGFSLTTYNVHWVRQAP<br>GKGLEWVGRMRYSGDTSFNAALTSRFTISRDNSKNTLYLQMN<br>SLRAEDTAVYYCASDPMYIPNYAYGVMNAWGQGTLVTVSS | 784 |
| CD3_SP9AFW4_VL_VH_S56G | EVQLVETGGGLVQPGGSRRLSCAASGFSLTTYNVHWVRQAP<br>GKGLEWVGRMRYSGDTSFNAALTSRFTISRDTSKNTVYLQMN<br>SLRAEDTGVYYCASDPMYIPNYAYGVMNAWGQGTLVTVSS | 785 |
| CD3_sp9aFW1_VLVH | EVQLVETGGGLVQPGGSRRLSCAASGFSLTTYNVHWVRQAP<br>GKGLEWVSRMRYSGDTSFNAALTSRFTISRDTSKNTVYLQMN<br>SLRAEDTGVYYCASDPMYIPNYAYGVMNAWGQGTLVTVSS | 786 |
| CD3_sp9aFW4_VLVH | VQLVESGGGLVQPGGSLRLSCAASGFSLTTYNVHWVRQAPG<br>KGLEWVSRMRYSGDTSFNAALTSRFTISRDNSKNTLYLQMNS<br>LRAEDTAVYYCASDPMYIPNYAYGVMNAWGQGTLVTVSS | 787 |
| CD3_sp9arabtor_VHVL | EVQLVESGGGSVQPGGSLRLSCTASGFSLTTYNVHWVRQAP<br>GKGLEWVGRMRYSGDTSFNAALTSRFTISRDTSKNTVYLQMN<br>SLRAEDTATYYCASDPMYIPNYAYGVMNAWGQGTTVTVSS | 788 |
| CD3_sp9arabtor_VLVH | EVQLVESGGGSVQPGGSLRLSCTASGFSLTTYNVHWVRQAP<br>GKGLEWVGRMRYSGDTSFNAALTSRFTISRDTSKNTVYLQMN<br>SLRAEDTATYYCASDPMYIPNYAYGVMNAWGQGTTVTVSS | 788 |
| CD3_sp11a_VHVL_YY_SANSPTM | QVQLVESGGGVVQPGRSLRLSCAASGFTFSKQGMHWVRQA<br>PGKGLEWVAMIYYDSSKMYYADTVKGRFTISRDNSKNTLYLQ<br>MNSLRAEDTAVYYCASFYYDLDFDHWGQGTMVTVSS | 789 |
| CD3_sp11a_VHVL_YY_SANSPTM_Y | QVQLVESGGGVVQPGRSLRLSCAASGFTFSKQGMHWVRQA<br>PGKGLEWVAMIYYDSSKMYYADTVKGRFTISRDNSKNTLYLQ<br>MNSLRAEDTAVYYCASYYYDLDFDHWGQGTMVTVSS | 790 |
| CD3_sp11a_VHVL_YY_SANSPTM_S | QVQLVESGGGVVQPGRSLRLSCAASGFTFSKQGMHWVRQA<br>PGKGLEWVAMIYYDSSKMYYADTVKGRFTISRDNSKNTLYLQ<br>MNSLRAEDTAVYYCASSYYDLDFDHWGQGTMVTVSS | 791 |
| CD3_sp11a_VHVL_YY_Y | QVQLVESGGGVVQPGRSLRLSCAASGFTFSKNGMHWVRQA<br>PGKGLEWVAMIYYDSSKMYYADTVKGRFTISRDNSKNTLYLQ<br>MNSLRAEDTAVYYCASYYYDLDFDHWGQGTMVTVSS | 792 |

TABLE AJ-1-continued

| CD3 Binders-Heavy chain variable sequences | | |
| --- | --- | --- |
| Binder | Sequence | SEQ ID NO: |
| CD3_sp11a_VHVL_YY_s | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSYYDLDFDHWGQGTMVTVSS | 793 |
| CD3_sp11a_VHVL_SS_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSSDLDFDHWGQGTMVTVSS | 794 |
| CD3_sp11a_VHVL_SS_ SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYSSDLDFDHWGQGTMVTVSS | 795 |
| CD3_sp11a_VHVL_SS_ SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSSSDLDFDHWGQGTMVTVSS | 796 |
| CD3_sp11a_VHVL_SS_ Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSSDLDFDHWGQGTMVTVSS | 797 |
| CD3_sp11a_VHVL_SS_ S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSSDLDFDHWGQGTMVTVSS | 798 |
| CD3_sp11a_VHVL_SS_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSSDLDFDHWGQGTMVTVSS | 794 |
| CD3_sp11a_VHVL_WS_ SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYWSDLDFDHWGQGTMVTVSS | 799 |
| CD3_sp11a_VHVL_WS_ SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSWSDLDFDHWGQGTMVTVSS | 800 |
| CD3_sp11a_VHVL_WS_ Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYWSDLDFDHWGQGTMVTVSS | 801 |
| CD3_sp11a_VHVL_WS_ S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSWSDLDFDHWGQGTMVTVSS | 802 |
| CD3_sp11a_VHVL_WS_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFWSDLDFDHWGQGTMVTVSS | 803 |
| CD3_sp11a_VHVL_SW_ SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYSWDLDFDHWGQGTMVTVSS | 804 |
| CD3_sp11a_VHVL_SW_ SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSSWDLDFDHWGQGTMVTVSS | 805 |
| CD3_sp11a_VHVL_SW_ Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSWDLDFDHWGQGTMVTVSS | 806 |
| CD3_sp11a_VHVL_SW_ S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSWDLDFDHWGQGTMVTVSS | 807 |
| CD3_sp11a_VHVL_SW_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSWDLDFDHWGQGTMVTVSS | 808 |
| CD3_sp11a_VHVL_TW_ SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYTWDLDFDHWGQGTMVTVSS | 809 |
| CD3_sp11a_VHVL_TW_ SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSTWDLDFDHWGQGTMVTVSS | 810 |

TABLE AJ-1-continued

CD3 Binders-Heavy chain variable sequences

| Binder | Sequence | SEQ ID NO: |
|--------|----------|------------|
| CD3_sp11a_VHVL_TW_ Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYTWDLDFDHWGQGTMVTVSS | 811 |
| CD3_sp11a_VHVL_TW_ S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSTWDLDFDHWGQGTMVTVSS | 812 |
| CD3_sp11a_VHVL_TW_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFTWDLDFDHWGQGTMVTVSS | 813 |
| CD3_sp11a_VHVL_TT_ SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYTTDLDFDHWGQGTMVTVSS | 814 |
| CD3_sp11a_VHVL_TT_ SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSTTDLDFDHWGQGTMVTVSS | 815 |
| CD3_sp11a_VHVL_TT_Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYTTDLDFDHWGQGTMVTVSS | 816 |
| CD3_sp11a_VHVL_TT_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSTTDLDFDHWGQGTMVTVSS | 817 |
| CD3_sp11a_VHVL_TT_ SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFTTDLDFDHWGQGTMVTVSS | 818 |
| CD3_SP11AVH3_VLK_ 3_Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYWDLDFDHWGQGTMVTVSS | 819 |
| CD3_SP11AVH3_VLK_ 3_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSWDLDFDHWGQGTMVTVSS | 820 |
| CD3_SP11AVH3_VLK_ 3_Y_PTM | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYWDLDFDHWGQGTMVTVSS | 819 |
| CD3_SP11AVH3_VLK_ 3_S_PTM | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSWDLDFDHWGQGTMVTVSS | 820 |
| CD3_SP11AVH3_VLK_ 3_Y_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSWDLDFDHWGQGTMVTVSS | 806 |
| CD3_SP11AVH3_VLK_ 3_S_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSWDLDFDHWGQGTMVTVSS | 807 |
| CD3_SP11AVH3_VLK_ 3_Y_PTM_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSWDLDFDHWGQGTMVTVSS | 806 |
| CD3_SP11AVH3_VLK_ 3_S_SWPTM | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSWDLDFDHWGQGTMVTVSS | 807 |
| CD3_SP11AVH3_VLK_ SWPTM | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSWDLDFDHWGQGTMVTVSS | 778 |
| CD3_SP11AVH3_VLK_ 3_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSWDLDFDHWGQGTMVTVSS | 778 |

TABLE AJ-1-continued

CD3 Binders-Heavy chain variable sequences

| Binder | Sequence | SEQ ID NO: |
|---|---|---|
| CD3_sp11a_VH1_VK2_Y | QVQLVQSGAEVKKPGASVKVSCKASGFTFSKQGMHWVRQA PGQGLEWMGMIYYDSSKMYYADTVKGRVTMTRDTSTNTLYM ELSSLRSEDTAVYYCASYWWDLDFDHWGQGTMVTVSS | 821 |
| CD3_sp11a_VH1_VK2_S | QVQLVQSGAEVKKPGASVKVSCKASGFTFSKQGMHWVRQA PGQGLEWMGMIYYDSSKMYYADTVKGRVTMTRDTSTNTLYM ELSSLRSEDTAVYYCASSWWDLDFDHWGQGTMVTVSS | 822 |
| CD3_sp11a_VH1_VK2_ Y_PTM | QVQLVQSGAEVKKPGASVKVSCKASGFTFSKNGMHWVRQAP GQGLEWMGMIYYDSSKMYYADTVKGRVTMTRDTSTNTLYME LSSLRSEDTAVYYCASYWWDLDFDHWGQGTMVTVSS | 823 |
| CD3_sp11a_VH1_VK2_ S_PTM | QVQLVQSGAEVKKPGASVKVSCKASGFTFSKQGMHWVRQA PGNGLEWMGMIYYDSSKMYYADTVKGRVTMTRDTSTNTLYM ELSSLRSEDTAVYYCASSWWDLDFDHWGQGTMVTVSS | 824 |
| CD3_sp11a_VH1_VK2_ Y_SW | QVQLVQSGAEVKKPGASVKVSCKASGFTFSKQGMHWVRQA PGQGLEWMGMIYYDSSKMYYADTVKGRVTMTRDTSTNTLYM ELSSLRSEDTAVYYCASYSWDLDFDHWGQGTMVTVSS | 825 |
| CD3_sp11a_VH1_VK2_ S_SW | QVQLVQSGAEVKKPGASVKVSCKASGFTFSKQGMHWVRQA PGQGLEWMGMIYYDSSKMYYADTVKGRVTMTRDTSTNTLYM ELSSLRSEDTAVYYCASSSWDLDFDHWGQGTMVTVSS | 826 |
| CD3_sp11a_VH1_VK2_ Y_PTM | QVQLVQSGAEVKKPGASVKVSCKASGFTFSKNGMHWVRQAP GQGLEWMGMIYYDSSKMYYADTVKGRVTMTRDTSTNTLYME LSSLRSEDTAVYYCASYSWDLDFDHWGQGTMVTVSS | 827 |
| CD3_sp11a_VH1_VK2_ S_PTM_SW | QVQLVQSGAEVKKPGASVKVSCKASGFTFSKQGMHWVRQA PGNGLEWMGMIYYDSSKMYYADTVKGRVTMTRDTSTNTLYM ELSSLRSEDTAVYYCASSSWDLDFDHWGQGTMVTVSS | 828 |
| CD3_sp11a_VH1_VK2_ SW | QVQLVQSGAEVKKPGASVKVSCKASGFTFSKQGMHWVRQA PGQGLEWMGMIYYDSSKMYYADTVKGRVTMTRDTSTNTLYM ELSSLRSEDTAVYYCASFSWDLDFDHWGQGTMVTVSS | 829 |
| CD3_sp11a_VH1_VK2_ SW_PTM | QVQLVQSGAEVKKPGASVKVSCKASGFTFSKQGMHWVRQA PGNGLEWMGMIYYDSSKMYYADTVKGRVTMTRDTSTNTLYM ELSSLRSEDTAVYYCASFSWDLDFDHWGQGTMVTVSS | 830 |
| CD3_SP11A_VH3_VLK1_ Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYWWDLDFDHWGQGTMVTVSS | 819 |
| CD3_SP11A_VH3_VLK1_ S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSWWDLDFDHWGQGTMVTVSS | 820 |
| CD3_SP11A_VH3_VLK1_ Y_PTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYWWDLDFDHWGQGTMVTVSS | 831 |
| CD3_SP11A_VH3_VLK1_ S_PTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSWWDLDFDHWGQGTMVTVSS | 832 |
| CD3_SP11A_VH3_VLK1_ Y_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSWDLDFDHWGQGTMVTVSS | 806 |
| CD3_SP11A_VH3_VLK1_ S_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSWWDLDFDHWGQGTMVTVSS | 820 |
| CD3_SP11A_VH3_VLK1_ Y_PTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYWWDLDFDHWGQGTMVTVSS | 831 |
| CD3_SP11A_VH3_VLK1_ S_PTM_SW | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSSWDLDFDHWGQGTMVTVSS | 805 |
| CD3_SP11A_VH3_VLK1_ PTM_SW | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSWDLDFDHWGQGTMVTVSS | 808 |

TABLE AJ-1-continued

| CD3 Binders-Heavy chain variable sequences | | |
|---|---|---|
| Binder | Sequence | SEQ ID NO: |
| CD3_SP11A_VH3_VLK1_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSWDLDFDHWGQGTMVTVSS | 778 |
| CD3_SP11A_VH5_VK2_Y | EVQLVQSGAEVKKPGESLKISCKGSGFTFSKQGMHWVRQMP GKGLEWMGMIYYDSSKMYYADTVKGQVTISRDNSINTLYLQW SSLKASDTAMYYCASYWWDLDFDHWGQGTMVTVSS | 833 |
| CD3_SP11A_VH5_VK2_S | EVQLVQSGAEVKKPGESLKISCKGSGFTFSKQGMHWVRQMP GKGLEWMGMIYYDSSKMYYADTVKGQVTISRDNSINTLYLQW SSLKASDTAMYYCASSWWDLDFDHWGQGTMVTVSS | 834 |
| CD3_SP11A_VH5_VK2_Y_PTM | EVQLVQSGAEVKKPGESLKISCKGSGFTFSKNGMHWVRQMP GKGLEWMGMIYYDSSKMYYADTVKGQVTISRDNSINTLYLQW SSLKASDTAMYYCASYWWDLDFDHWGQGTMVTVSS | 835 |
| CD3_SP11A_VH5_VK2_S_PTM | EVQLVQSGAEVKKPGESLKISCKGSGFTFSKNGMHWVRQMP GKGLEWMGMIYYDSSKMYYADTVKGQVTISRDNSINTLYLQW SSLKASDTAMYYCASSWVDLDFDHWGQGTMVTVSS | 836 |
| CD3_SP11A_VH5_VK2_Y_SW | EVQLVQSGAEVKKPGESLKISCKGSGFTFSKQGMHWVRQMP GKGLEWMGMIYYDSSKMYYADTVKGQVTISRDNSINTLYLQW SSLKASDTAMYYCASYSWDLDFDHWGQGTMVTVSS | 837 |
| CD3_SP11A_VH5_VK2_S_SW | EVQLVQSGAEVKKPGESLKISCKGSGFTFSKQGMHWVRQMP GKGLEWMGMIYYDSSKMYYADTVKGQVTISRDNSINTLYLQW SSLKASDTAMYYCASSSWDLDFDHWGQGTMVTVSS | 838 |
| CD3_SP11A_VH5_VK2_Y_PTM_SW | EVQLVQSGAEVKKPGESLKISCKGSGFTFSKNGMHWVRQMP GKGLEWMGMIYYDSSKMYYADTVKGQVTISRDNSINTLYLQW SSLKASDTAMYYCASYSWDLDFDHWGQGTMVTVSS | 839 |
| CD3_SP11A_VH5_VK2_S_PTM_SW | EVQLVQSGAEVKKPGESLKISCKGSGFTFSKNGMHWVRQMP GKGLEWMGMIYYDSSKMYYADTVKGQVTISRDNSINTLYLQW SSLKASDTAMYYCASSSWDLDFDHWGQGTMVTVSS | 840 |
| CD3_SP11A_VH5_VK2_PTM_SW | EVQLVQSGAEVKKPGESLKISCKGSGFTFSKNGMHWVRQMP GKGLEWMGMIYYDSSKMYYADTVKGQVTISRDNSINTLYLQW SSLKASDTAMYYCASFSWDLDFDHWGQGTMVTVSS | 841 |
| CD3_SP11A_VH5_VK2_SW | EVQLVQSGAEVKKPGESLKISCKGSGFTFSKQGMHWVRQMP GKGLEWMGMIYYDSSKMYYADTVKGQVTISRDNSINTLYLQW SSLKASDTAMYYCASFSWDLDFDHWGQGTMVTVSS | 842 |

TABLE AJ-2

| CD3 Binders-Light chain variable sequences | | |
|---|---|---|
| Binder | Sequence | SEQ ID NO: |
| NOV292 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| NOV123 | DVVMTQSPLSLPVTLGQPASISCRSSQSLIYSIGNTYLHWYQQ RPGQSPRLLIYRVSNRFSGVPDRFSGSGSGTDFTLKISRVEAE DVGVYYCFQSTHLPYTFGQGTKLEIK | 844 |
| Sp10b | WVLTQTPVSLPVSLGGQASISCRSSQSLIYSIGNTYLHWYLQ KPGQSPQLLIYRVSNRFSGVPDRFSGSGSGTDFTLKISRVEPE DLGDYYCFQSTHLPYTFGAGTKLELK | 845 |
| NOV453 | DIQMTQSPSSLSASVGDRVTITCKASQNINNYLNWYQQKPGK APKLLIYNTDHLQAGVPSRFSGSGSGTDYTLTISSLQPEDFATY FCLQHRSRYTFGPGTKVDIK | 846 |
| NOV229 | DIQMTQSPSSLSASVGDRVTITCKASQNINNYLNWYQQKPGK APKLLIYNTDHLQAGVPSRFSGSGSGTDFTLTISSLQPEDFATY YCLQHRSRYTFGPGTKVDIK | 847 |

TABLE AJ-2-continued

CD3 Binders-Light chain variable sequences

| Binder | Sequence | SEQ ID NO: |
|---|---|---|
| NOV110 | DVVMTQSPLSLPVTLGQPASISCRSSQSLVYSHGNTYLHWYQ QRPGQSPRLLIYRVSNRFSGVPDRFSGSGSGTDFTLKISRVEA EDVGVYYCFQSTHLPYTFGQGTKLEIK | 848 |
| NOV832 | DVVMTQSPLSLPVTLGQPASISCRSSQSLVYSHGNTYLHWFQ QRPGQSPRRLIYRVSNRFSGVPDRFSGSGSGTDFTLKISRVE AEDVGVYYCFQSTHLPYTFGQGTKLEIK | 849 |
| NOV589 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| NOV580 | DIQMTQSPSSLSASVGDRVTITCKTSQNIDKYLNWYQQKPGK APKLLIYNTNNLEAGVPSRFSGSGSGTDYTFTISSLQPEDIATY FCLQHRSSYTFGQGTKLEIK | 850 |
| NOV567 | DIQMTQSPSSLSASVGDRVTITCRGSQSIGNSLNWYQQKPGK APKRLIYSTSTLEYGVPSRFSGSGSGTEYTLTISSLQPEDFATY YCLQYATYPYTFGQGTKLEIK | 851 |
| NOV221 | DIQMTQSPSSLSASVGDRVTITCKSSQNIDKYLNWYQQKPGK APKLLIYNTNNLEAGVPSRFSGSGSGTDYTFTISSLQPEDIATY FCLQHRSGYTFGQGTKLEIK | 852 |
| CD3_sp11a_bkm1 | DIVMTQTPLSSPVTLGQPASISCRSSQSLVRSDGTTYFNWLQ QRPGQPPRLLIYRVSNRFSGVPDRFSGSGAGTDFTLKISRVEA EDVGVYYCLQSSHFPWTFGGGTKVEIK | 853 |
| CD3_SP11a_bkm2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_hz0 | DIVMTQTPLSSPVTLGQPASISCRSSQSLVRSDGTTYFNWLQ QRPGQPPRLLIYRVSNRFSGVPDRFSGSGAGTDFTLKISRVEA EDVGVYYCLQSSHFPWTFGGGTKVEIK | 853 |
| CD3_SP11A_HZ1 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSH | 854 |
| CD3_sp11a_sansPTM_hz1 | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_sansPTM_rat | DILVTQTPVSLPVSLGGHVSISCRSSQSLVRSEGTTYFNWYLQ KPGQSPQLLIYRVSNRFSGVPDRFSGSGSGTDFTLKISRVEPE DLGVYYCLQSSHFPWTFGGGTKLELK | 856 |
| CD3_sp11a_VHVL_YY | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VHVL_SS | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VHVL_WS | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_SW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VHVL_TT | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VHVL_TW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VHVL_WT | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |

TABLE AJ-2-continued

CD3 Binders-Light chain variable sequences

| Binder | Sequence | SEQ ID NO: |
|--------|----------|------------|
| CD3_SP11A VH3_VLK_3 | EIVLTQSPGTLSLSPGERATLSCRSSQSLVRSEGTTYFNWYQ QKPGQAPRLLIYRVSNRFSGIPDRFSGSGSGTDFTLTISRLEPE DLAVYYCLQSSHFPWTFGGGTKVEIK | 857 |
| CD3_sp11a_VH1_VK2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VH3_VLK1 | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH5_VK2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp9aFW1_VL_VH_ S56G | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_SP9AFW4_VL_VH_ S56G | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_sp9aFW1_VLVH | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_sp9aFW4_VLVH | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_sp9arabtor_VHVL | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_sp9arabtor_VLVH | EIVMTQSPSTLSASVGDRVIITCKASQNINNYLNWYQQKPGKA PKLLIYNTDHLQAGVPSRFSGSGSGAEFTLTISSLQPDDFATYY CLQHRSRYTFGQGTKLTVL | 859 |
| CD3_sp11a_VHVL_YY_ SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_YY_ SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_YY_ SANSPTM_S | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_YY_ Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_YY_s | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_SS_ SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SS_ SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SS_ SANSPTM_S | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SS_ Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |

TABLE AJ-2-continued

CD3 Binders-Light chain variable sequences

| Binder | Sequence | SEQ ID NO: |
|---|---|---|
| CD3_sp11a_VHVL_SS_S | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_SS_SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_WS_SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_WS_SANSPTM_S | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_WS_Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_WS_S | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_WS_SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SW_SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SW_SANSPTM_S | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_SW_Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_SW_S | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_SW_SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_TW_SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_TW_SANSPTM_S | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_TW_Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_TW_S | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VHVL_TW_SANSPTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VHVL_TT_SANSPTM_Y | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |

TABLE AJ-2-continued

CD3 Binders-Light chain variable sequences

| Binder | Sequence | SEQ ID NO: |
|---|---|---|
| CD3_sp11a_VH VL_TT_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 855 |
| CD3_sp11a_VHVL_TT_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_sp11a_VHVL_TT_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_sp11a_VHVL_TT_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 855 |
| CD3_SP11AVH3_VLK_3_Y | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 857 |
| CD3_SP11AVH3_VLK_3_S | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 857 |
| CD3_SP11AVH3_VLK_3_Y_PTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 860 |
| CD3_SP11AVH3_VLK_3_S_PTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 860 |
| CD3_SP11AVH3_VLK_3_Y_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 857 |
| CD3_SP11AVH3_VLK_3_S_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 857 |
| CD3_SP11AVH3_VLK_3_Y_PTM_SW | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 860 |
| CD3_SP11AVH3_VLK_3_S_SWPTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 860 |
| CD3_SP11AVH3_VLK_SWPTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 860 |
| CD3_SP11AVH3_VLK_3_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 857 |
| CD3_sp11a_VH1_VK2_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_sp11a_VH1_VK2_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_sp11a_VH1_VK2_Y_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 855 |
| CD3_sp11a_VH1_VK2_S_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 855 |
| CD3_sp11a_VH1_VK2_Y_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |

TABLE AJ-2-continued

CD3 Binders-Light chain variable sequences

| Binder | Sequence | SEQ ID NO: |
|---|---|---|
| CD3_sp11a_VH1_VK2_S_SW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VH1_VK2_Y_PTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VH1_VK2_S_PTM_SW | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_sp11a_VH1_VK2_SW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_sp11a_VH1_VK2_SW_PTM | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 855 |
| CD3_SP11A_VH3_VLK1_Y | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH3_VLK1_S | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH3_VLK1_Y_PTM | DIQMTQSPSSLSASVGDRVTITCRSSQSLVRSDGTTYFNWYQ QKPGKAPKLLIYRVSNRFSGVPSRFSGSGSGTDFTLTISSLQP EDFATYYCLQSSHFPWTFGGGTKVEIK | 861 |
| CD3_SP11A_VH3_VLK1_S_PTM | DIQMTQSPSSLSASVGDRVTITCRSSQSLVRSDGTTYFNWYQ QKPGKAPKLLIYRVSNRFSGVPSRFSGSGSGTDFTLTISSLQP EDFATYYCLQSSHFPWTFGGGTKVEIK | 861 |
| CD3_SP11A_VH3_VLK1_Y_SW | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH3_VLK1_S_SW | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH3_VLK1_Y_PTM | DIQMTQSPSSLSASVGDRVTITCRSSQSLVRSDGTTYFNWYQ QKPGKAPKLLIYRVSNRFSGVPSRFSGSGSGTDFTLTISSLQP EDFATYYCLQSSHFPWTFGGGTKVEIK | 861 |
| CD3_SP11A_VH3_VLK1_S_PTM_SW | DIQMTQSPSSLSASVGDRVTITCRSSQSLVRSDGTTYFNWYQ QKPGKAPKLLIYRVSNRFSGVPSRFSGSGSGTDFTLTISSLQP EDFATYYCLQSSHFPWTFGGGTKVEIK | 861 |
| CD3_SP11A_VH3_VLK1_PTM_SW | DIQMTQSPSSLSASVGDRVTITCRSSQSLVRSDGTTYFNWYQ QKPGKAPKLLIYRVSNRFSGVPSRFSGSGSGTDFTLTISSLQP EDFATYYCLQSSHFPWTFGGGTKVEIK | 861 |
| CD3_SP11A_VH3_VLK1_SW | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 858 |
| CD3_SP11A_VH5_VK2_Y | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VH5_VK2_S | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |
| CD3_SP11A_VH5_VK2_Y_PTM | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 843 |

TABLE AJ-2-continued

CD3 Binders-Light chain variable sequences

| Binder | Sequence | SEQ ID NO: |
|---|---|---|
| CD3_SP11A_VH5_VK2_S_PTM | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_Y_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_S_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_Y_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_S_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |
| CD3_SP11A_VH5_VK2_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 843 |

The group C1 CDR sequences in Table AA are based upon the Kabat CDR sequences, Chothia CDR sequences, IMGT CDR sequences, and combinations thereof, of the CD3 binding molecules NOV292, NOV589, NOV567, and the CD3 binding molecules which include "sp11a" in the binder name. The group C2 CDR sequences in Table AB are based upon the Kabat CDR sequences, Chothia CDR sequences, IMGT CDR sequences, and combinations thereof, of the CD3 binding molecules NOV453, NOV229, NOV580, NOV221, and the CD3 binding molecules which include "sp9a" in the binder name. The group C3 CDR sequences in Table AC are based upon the Kabat CDR sequences, Chothia CDR sequences, IMGT CDR sequences, and combinations thereof, of the CD3 binding molecules NOV123, sp10b, NOV110, and NOV832.

The specific CDR sequences of the CD3 binding molecules described in the Examples of WO 2020/052692 are listed in Table AB-1 to Table AH-2. VH and VL sequences described in WO 2020/052692 are listed in Table AJ-1 and Table AJ-2, respectively.

In some embodiments, a CD3 ABM can comprise a heavy chain CDR having an amino acid sequence of any one of the CDR consensus sequences listed in Table AA, Table AB, or Table AC. In particular embodiments, a CD3 ABM can comprise (or alternatively, consist of) one, two, three, or more heavy chain CDRs selected from the heavy chain CDRs described in Table AA, Table AB, or Table AC.

In some embodiments, a CD3 ABM can comprise a light chain CDR having an amino acid sequence of any one of the CDR consensus sequences listed in Table AA, Table AB, or Table AC. In particular embodiments, a CD3 ABM can comprise (or alternatively, consist of) one, two, three, or more light chain CDRs selected from the light chain CDRs described in Table AA, Table AB, or Table AC.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AA.

In some embodiments, the amino acid designated $X_1$ in Table AA is T. In some embodiments, the amino acid designated $X_1$ in Table AA is A. In some embodiments, the amino acid designated $X_2$ in Table AA is S. In some embodiments, the amino acid designated $X_2$ in Table AA is R. In some embodiments, the amino acid designated $X_3$ in Table AA is N. In some embodiments, the amino acid designated $X_3$ in Table AA is Y. In some embodiments, the amino acid designated $X_3$ in Table AA is Q. In some embodiments, the amino acid designated $X_4$ in Table AA is H. In some embodiments, the amino acid designated $X_4$ in Table AA is S. In some embodiments, the amino acid designated $X_5$ in Table AA is M. In some embodiments, the amino acid designated $X_5$ in Table AA is L. In some embodiments, the amino acid designated $X_6$ in Table AA is K. In some embodiments, the amino acid designated $X_6$ in Table AA is R. In some embodiments, the amino acid designated $X_7$ in Table AA is S. In some embodiments, the amino acid designated $X_7$ in Table AA is K. In some embodiments, the amino acid designated $X_{55}$ in Table AA is F. In some embodiments, the amino acid designated $X_{55}$ in Table AA is Y. In some embodiments, the amino acid designated $X_{55}$ in Table AA is S. In some embodiments, the amino acid designated $X_8$ in Table AA is W. In some embodiments, the amino acid designated $X_8$ in Table AA is Y. In some embodiments, the amino acid designated $X_8$ in Table AA is S. In some embodiments, the amino acid designated $X_8$ in Table AA is T. In some embodiments, the amino acid designated $X_9$ in Table AA is W. In some embodiments, the amino acid designated $X_9$ in Table AA is Y. In some embodiments, the amino acid designated $X_9$ in Table AA is S. In some embodiments, the amino acid designated $X_9$ in Table AA is T. In some embodiments, the amino acid designated $X_{10}$ in Table AA is H. In some embodiments, the amino acid designated $X_{10}$ in Table AA is Y. In some embodiments, the amino acid designated $X_{11}$ in Table AA is S. In some embodiments, the amino acid designated $X_{11}$ in Table AA is G. In some embodiments, the amino acid designated $X_{12}$ in Table AA is I. In some embodiments, the amino acid designated $X_{12}$ in Table AA is L. In some embodiments, the amino acid designated $X_{13}$ in Table AA is V. In some embodiments, the amino acid designated $X_{13}$ in Table AA is G. In some embodiments, the amino acid designated $X_{14}$ in Table AA is R. In some embodiments, the amino acid designated $X_{14}$ in Table AA is N. In some embodiments, the amino acid designated $X_{15}$ in Table AA is D. In some embodiments, the amino acid designated $X_{15}$ in Table AA is E. In some embodiments, the amino acid designated $X_{15}$ in Table AA is L. In some embodiments, the amino acid designated $X_{16}$ in Table AA is G. In some embodiments, the amino acid designated $X_{16}$ in Table AA is N. In some embodiments, the amino acid designated $X_{16}$ in Table AA is E. In some embodiments, the amino acid designated $X_{17}$ in Table AA is R. In some embodiments, the amino acid designated $X_{17}$ in Table AA is S. In some embodiments, the amino acid designated $X_{18}$ in Table AA is V. In some embodiments, the amino acid designated $X_{18}$ in Table AA is T. In some embodiments, the amino acid designated $X_{19}$ in Table AA is N. In some embodiments, the amino acid designated $X_{19}$ in Table AA is T. In some embodiments, the amino acid designated $X_{20}$ in Table AA is R. In some embodiments, the amino acid designated $X_{20}$ in Table AA is L. In some embodiments, the amino acid designated $X_{21}$ in Table AA is F. In some embodiments, the amino acid designated $X_{21}$ in Table AA is E. In some embodiments, the amino acid designated $X_{22}$ in Table AA is S. In some embodiments, the amino acid designated $X_{22}$ in Table AA is Y. In some embodiments, the amino acid designated $X_{23}$ in Table AA is S. In some embodiments, the amino acid designated $X_{23}$ in Table AA is Y. In some embodiments, the amino acid designated $X_{24}$ in Table AA is S. In some embodiments, the amino acid designated $X_{24}$ in Table AA is A. In some embodiments, the amino acid designated $X_{25}$ in Table AA is H. In some embodiments, the amino acid designated $X_{25}$ in Table AA is T. In some embodiments, the amino acid designated $X_{26}$ in Table AA is F. In some embodiments, the amino acid designated $X_{26}$ in Table AA is Y. In some embodiments, the amino acid designated $X_{27}$ in Table AA is W. In some embodiments, the amino acid designated $X_{27}$ in Table AA is Y.

In some embodiments, a CD3 ABM can comprise the CDR-H1 sequence C1-1. In some embodiments, a CD3 ABM can comprise the CDR-H1 sequence C1-2. In some embodiments, a CD3 ABM can comprise the CDR-H1 sequence C1-3. In some embodiments, a CD3 ABM can comprise the CDR-H1 sequence C1-4.

In some embodiments, a CD3 ABM can comprise the CDR-H2 sequence C1-5. In some embodiments, a CD3 ABM can comprise the CDR-H2 sequence C1-6. In some embodiments, a CD3 ABM can comprise the CDR-H2 sequence C1-7.

In some embodiments, a CD3 ABM can comprise the CDR-H3 sequence C1-8. In some embodiments, a CD3 ABM can comprise the CDR-H3 sequence C1-9. In some embodiments, a CD3 ABM can comprise the CDR-H3 sequence C1-10. In some embodiments, a CD3 ABM can comprise the CDR-H3 sequence C1-11.

In some embodiments, a CD3 ABM can comprise the CDR-L1 sequence C1-12. In some embodiments, a CD3 ABM can comprise the CDR-L1 sequence C1-13. In some embodiments, a CD3 ABM can comprise the CDR-L1 sequence C1-14. In some embodiments, a CD3 ABM can comprise the CDR-L1 sequence C1-15. In some embodiments, a CD3 ABM can comprise the CDR-L1 sequence C1-16. In some embodiments, a CD3 ABM can comprise the CDR-L1 sequence C1-17.

In some embodiments, a CD3 ABM can comprise the CDR-L2 sequence C1-18. In some embodiments, a CD3 ABM can comprise the CDR-L2 sequence C1-19.

In some embodiments, a CD3 ABM can comprise the CDR-L3 sequence C1-20. In some embodiments, a CD3 ABM can comprise the CDR-L3 sequence C1-21. In some embodiments, a CD3 ABM can comprise the CDR-L3 sequence C1-22. In some embodiments, a CD3 ABM can comprise the CDR-L3 sequence C1-23.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AB.

In some embodiments, the amino acid designated $X_{28}$ in Table AB is V. In some embodiments, the amino acid designated $X_{28}$ in Table AB is I. In some embodiments, the amino acid designated $X_{29}$ in Table AB is F. In some embodiments, the amino acid designated $X_{29}$ in Table AB is Y. In some embodiments, the amino acid designated $X_{30}$ in Table AB is N. In some embodiments, the amino acid designated $X_{30}$ in Table AB is S. In some embodiments, the amino acid designated $X_{31}$ in Table AB is A. In some embodiments, the amino acid designated $X_{31}$ in Table AB is S. In some embodiments, the amino acid designated $X_{32}$ in Table AB is T. In some embodiments, the amino acid designated $X_{32}$ in Table AB is K. In some embodiments, the amino acid designated $X_{33}$ in Table AB is T. In some embodiments, the amino acid designated $X_{33}$ in Table AB is A. In some embodiments, the amino acid designated $X_{34}$ in Table AB is S. In some embodiments, the amino acid designated $X_{34}$ in Table AB is R. In some embodiments, the amino acid designated $X_{35}$ in Table AB is N. In some embodiments, the amino acid designated $X_{35}$ in Table AB is G. In some embodiments, the amino acid designated $X_{36}$ in Table AB is S. In some embodiments, n the amino acid designated $X_{36}$ in Table AB is A. In some embodiments, the amino acid designated $X_{37}$ in Table AB is A. In some embodiments, the amino acid designated $X_{37}$ in Table AB is T. In some embodiments, the amino acid designated $X_{37}$ in Table AB is S. In some embodiments, the amino acid designated $X_{38}$ in Table AB is N. In some embodiments, the amino acid designated $X_{38}$ in Table AB is D. In some embodiments, the amino acid designated $X_{39}$ in Table AB is N. In some embodiments, the amino acid designated $X_{39}$ in Table AB is K. In some embodiments, the amino acid designated $X_{40}$ in Table AB is D. In some embodiments, the amino acid designated $X_{40}$ in Table AB is N. In some embodiments, the amino acid designated $X_{41}$ in Table AB is H. In some embodiments, the amino acid designated $X_{41}$ in Table AB is N. In some embodiments, the amino acid designated $X_{42}$ in Table AB is Q. In some embodiments, the amino acid designated $X_{42}$ in Table AB is E. In some embodiments, the amino acid designated $X_{43}$ in Table AB is R. In some embodiments, the amino acid designated $X_{43}$ in Table AB is S. In some embodiments, the amino acid designated $X_{43}$ in Table AB is G.

In some embodiments, a CD3 ABM can comprise the CDR-H1 sequence C2-1. In some embodiments, a CD3 ABM can comprise the CDR-H1 sequence C2-2. In some embodiments, a CD3 ABM can comprise the CDR-H1 sequence C2-3. In some embodiments, a CD3 ABM can comprise the CDR-H1 sequence C2-4.

In some embodiments, a CD3 ABM can comprise the CDR-H2 sequence C2-5. In some embodiments, a CD3 ABM can comprise the CDR-H2 sequence C2-6. In some embodiments, a CD3 ABM can comprise the CDR-H2 sequence C2-7.

In some embodiments, a CD3 ABM can comprise the CDR-H3 sequence C2-8. In some embodiments, a CD3 ABM can comprise the CDR-H3 sequence C2-9.

In some embodiments, a CD3 ABM can comprise the CDR-L1 sequence C2-10. In some embodiments, a CD3 ABM can comprise the CDR-L1 sequence C2-11. In some embodiments, a CD3 ABM can comprise the CDR-L1 sequence C2-12.

In some embodiments, a CD3 ABM can comprise the CDR-L2 sequence C2-13. In some embodiments, a CD3 ABM can comprise the CDR-L2 sequence C2-14. In some embodiments, a CD3 ABM can comprise the CDR-L2 sequence C2-15.

In some embodiments, a CD3 ABM can comprise the CDR-L3 sequence C2-16. In some embodiments, a CD3 ABM can comprise the CDR-L3 sequence C2-17.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AC.

In some embodiments, the amino acid designated $X_{44}$ in Table AC is G. In some embodiments, the amino acid designated $X_{44}$ in Table AC is A. In some embodiments, the amino acid designated $X_{45}$ in Table AC is H. In some embodiments, the amino acid designated $X_{45}$ in Table AC is N. In some embodiments, the amino acid designated $X_{46}$ in Table AC is D. In some embodiments, the amino acid designated $X_{46}$ in Table AC is G. In some embodiments, the amino acid designated $X_{47}$ in Table AC is A. In some embodiments, the amino acid designated $X_{47}$ in Table AC is G. In some embodiments, the amino acid designated $X_{48}$ in Table AC is N. In some embodiments, the amino acid designated $X_{48}$ in Table AC is K. In some embodiments, the amino acid designated $X_{49}$ in Table AC is V. In some embodiments, the amino acid designated $X_{49}$ in Table AC is A. In some embodiments, the amino acid designated $X_{50}$ in Table AC is N. In some embodiments, the amino acid designated $X_{50}$ in Table AC is V. In some embodiments, the amino acid designated $X_{51}$ in Table AC is A. In some embodiments, the amino acid designated $X_{51}$ in Table AC is V. In some embodiments, the amino acid designated $X_{52}$ in Table AC is Y. In some embodiments, the amino acid designated $X_{52}$ in Table AC is F. In some embodiments, the amino acid designated $X_{53}$ in Table AC is I. In some embodiments, the amino acid designated $X_{53}$ in Table AC is V. In some embodiments, the amino acid designated $X_{54}$ in Table AC is I. In some embodiments, the amino acid designated $X_{54}$ in Table AC is H.

In some embodiments, a CD3 ABM can comprise the CDR-H1 sequence C3-1. In some embodiments, a CD3 ABM can comprise the CDR-H1 sequence C3-2. In some embodiments, a CD3 ABM can comprise the CDR-H1 sequence C3-3. In some embodiments, a CD3 ABM can comprise the CDR-H1 sequence C3-4.

In some embodiments, a CD3 ABM can comprise the CDR-H2 sequence C3-5. In some embodiments, a CD3 ABM can comprise the CDR-H2 sequence C3-6. In some embodiments, a CD3 ABM can comprise the CDR-H2 sequence C3-7.

In some embodiments, a CD3 ABM can comprise the CDR-H3 sequence C3-8. In some embodiments, a CD3 ABM can comprise the CDR-H3 sequence C3-9.

In some embodiments, a CD3 ABM can comprise the CDR-L1 sequence C3-10. In some embodiments, a CD3 ABM can comprise the CDR-L1 sequence C3-11. In some embodiments, a CD3 ABM can comprise the CDR-L1 sequence C3-12.

In some embodiments, a CD3 ABM can comprise the CDR-L2 sequence C3-13. In some embodiments, a CD3 ABM can comprise the CDR-L2 sequence C3-14.

In some embodiments, a CD3 ABM can comprise the CDR-L3 sequence C3-15. In some embodiments, a CD3 ABM can comprise the CDR-L3 sequence C3-16.

In some embodiments, a CD3 ABM can comprise CDR-H1, CDR-H2, and CDR-H3 sequences set forth in Table AD-1 and the corresponding CDR-L1, CDR-L2, and CDR-L3 sequences set forth in Table AD-2.

In some embodiments, a CD3 ABM can comprise CDR-H1, CDR-H2, and CDR-H3 sequences set forth in Table AE-1 and the corresponding CDR-L1, CDR-L2, and CDR-L3 sequences set forth in Table AE-2.

In some embodiments, a CD3 ABM can comprise CDR-H1, CDR-H2, and CDR-H3 sequences set forth in Table AF-1 and the corresponding CDR-L1, CDR-L2, and CDR-L3 sequences set forth in Table AF-2.

In some embodiments, a CD3 ABM can comprise CDR-H1, CDR-H2, and CDR-H3 sequences set forth in Table AG-1 and the corresponding CDR-L1, CDR-L2, and CDR-L3 sequences set forth in Table AG-2.

In some embodiments, a CD3 ABM can comprise CDR-H1, CDR-H2, and CDR-H3 sequences set forth in Table AH-1 and the corresponding CDR-L1, CDR-L2, and CDR-L3 sequences set forth in Table AH-2.

In some embodiments, a CD3 ABM can comprise CDR-H1, CDR-H2, and CDR-H3 sequences set forth in Table AI-1 and the corresponding CDR-L1, CDR-L2, and CDR-L3 sequences set forth in Table AI-2.

In some embodiments, a CD3 ABM can comprise a heavy chain CDR having an amino acid sequence of any one of the CDRs listed in Table AB-1, Table AC-1, Table AD-1, Table AE-1, Table AF-1, Table AG-1, Table AH-1, or Table AI-1. In particular embodiments, a CD3 ABM can comprise (or alternatively, consist of) one, two, three, or more heavy chain CDRs selected the heavy chain CDRs described in Table AB-1, Table AC-1, Table AD-1, Table AE-1, Table AF-1, Table AG-1, Table AH-1, and Table AI-1.

In some embodiments, a CD3 ABM can comprise a light chain CDR having an amino acid sequence of any one of the CDRs listed in Table AB-2, Table AC-2, Table AD-2, Table AE-2, Table AF-2, Table AG-2, Table AH-2, or Table AI-2. In particular embodiments, a CD3 ABM can comprise (or alternatively, consist of) one, two, three, or more light chain CDRs selected the light chain CDRs described in Table AB-2, Table AC-2, Table AD-2, Table AE-2, Table AF-2, Table AG-2, Table AH-2, and Table AI-2.

Other CD3 ABMs include amino acids that have been mutated, yet have at least 80, 85, 90, 95, 96, 97, 98, or 99 percent identity in the CDR regions with the CDR sequences described in Table A. In some embodiments, such CD3 ABMs include mutant amino acid sequences where no more than 1, 2, 3, 4 or 5 amino acids have been mutated in the CDR regions when compared with the CDR sequences described in Table A.

In some embodiments, a CD3 ABM can comprise a VH and/or VL domain having an amino acid sequence of any VH and/or VL domain described in Table A. Other CD3 ABMs include VH and/or VL domains comprising amino acid sequences having at least 80, 85, 90, 95, 96, 97, 98, or 99 percent identity to the VH and/or VL sequences described in Table A. In some embodiments, CD3 ABMs include VH and/or VL domains where no more than 1, 2, 3, 4 or 5 amino acids have been mutated when compared with the VH and/or VL domains depicted in the sequences described in Table A, while retaining substantially the same therapeutic activity.

VH and VL sequences (amino acid sequences and the nucleotide sequences encoding the amino acid sequences) can be "mixed and matched" to create other CD3 ABMs. Such "mixed and matched" CD3 ABMs can be tested using binding assays known in the art (e.g., FACS assays). When chains are mixed and matched, a VH sequence from a particular VH/VL pairing should be replaced with a structurally similar VH sequence. A VL sequence from a particular VH/VL pairing should be replaced with a structurally similar VL sequence.

Accordingly, in one embodiment, a CD3 ABM comprises: a heavy chain variable region (VH) comprising an amino acid sequence selected from any one of the VH sequences described in Table A-J1; and a light chain variable region (VL) comprising an amino acid sequence described in Table A-J2.

In some embodiments, the antigen-binding domain that specifically binds to human CD3 is non-immunoglobulin based and is instead derived from a non-antibody scaffold protein, for example one of the non-antibody scaffold proteins described in Section 7.2.2. In an embodiment, the antigen-binding domain that specifically binds to human CD3 comprises Affilin-144160, which is described in WO 2017/013136. Affilin-144160 has the following amino acid sequence:

(SEQ ID NO: 498)
MQIFVKTLTGKTITLEVEPSDTIENVKAKIQDKEGIPPDQQWLWFAGKQ

LEDGRTLSDYNIQKESTLKLWLVDKAAMQIFVYTRTGKTITLEVEPSDT

IENVKAKIQDKEGIPPDQQRLIWAGKQLEDGRTLSDYNIALESGLHLVL

RLRAA 7.6.2. TCR-α/β ABMs

The MBMs (e.g., TBMs) can contain an ABM that specifically binds to the TCR-α chain, the TCR-β chain, or the TCR-αβ dimer. Exemplary anti-TCR-α/β antibodies are known (see, e.g., US 2012/0034221; Borst et al., 1990, Hum Immunol. 29(3):175-88 (describing antibody BMA031)). The VH, VL, and Kabat CDR sequences of antibody BMA031 are provided in Table 13.

TABLE 13

| | BMA031 sequences | |
|---|---|---|
| Domain | Sequence | SEQ ID NO: |
| BMA031 CDR-H1 | KASGYKFTSYVMH | 499 |
| BMA031 CDR-H2 | YINPYNDVTKYNEKFK | 500 |
| BMA031 CDR-H3 | GSYYDYDGFVY | 501 |
| BMA031 CDR-L1 | SATSSVSYMH | 502 |
| BMA031 CDR-L2 | DTSKLAS | 406 |
| BMA031 CDR-L3 | QQWSSNPLT | 435 |
| BMA031 VH | EVQLQQSGPELVKPGASVKMSCKASGYKFTSYVMHWVKQKPGQGLE WIGYINPYNDVTKYNEKFKGKATLTSDKSSSTAYMELSSLTSEDSAVH YCARGSYYDYDGFVYWGQGTLVTVSA | 503 |
| BMA031 VL | QIVLTQSPAIMSASPGEKVTMTCSATSSVSYMHWYQQKSGTSPKRWI YDTSKLASGVPARFSGSGSGTSYSLTISSMEAEDAATYYCQQWSSNP LTFGAGTKLELK | 504 |

In an embodiment, an ABM2 can comprise the CDR sequences of antibody BMA031. In other embodiments, an ABM2 can comprise the VH and VL sequences of antibody BMA031.

7.6.3. TCR-γ/δ ABMs

The MBMs (e.g., TBMs) can contain an ABM that specifically binds to the TCR-γ chain, the TCR-δ chain, or the TCR-γδ dimer. Exemplary anti-TCR-γδ antibodies are known (see, e.g., U.S. Pat. No. 5,980,892 (describing δTCS1, produced by the hybridoma deposited with the ATCC as accession number HB 9578)).

7.7. CD2 ABMs 7.7.1. Immunoglobulin-Based CD2 ABMs

A MBM (e.g., a TBM) can comprise an ABM which is an anti-CD2 antibody or an antigen-binding domain thereof. Exemplary anti-CD2 antibodies are known (see, e.g., U.S. Pat. No. 6,849,258, CN102827281A, US 2003/0139579 A1, and U.S. Pat. No. 5,795,572). Table 14 provides exemplary CDR, VH, and VL sequences that can be included in anti-CD2 antibodies or antigen-binding fragments thereof, for use in MBMs of the disclosure.

TABLE 14

| Immunoglobulin Based CD2 Binders | | | |
|---|---|---|---|
| Name | Domain | Sequence | SEQ ID NO: |
| CD2-1 | CDR-H1 | EYYMY (Rat Lo-CD2a = BTI-322 from FIG. 33 of USP 6,849,258) | 505 |
| CD2-1 | CDR-H2 | RIDPEDGSIDYVEKFKK (Rat Lo-CD2a = BTI-322 from FIG. 33 of USP 6,849,258) | 506 |
| CD2-1 | CDR-H3 | GKFNYRFAY (Rat Lo-CD2a = BTI-322 from Fig. 33 of USP 6,849,258) | 507 |
| CD2-1 | CDR-L1 | RSSQSLLHSSGNTYLN (Rat Lo-CD2a = BTI-322 from FIG. 31 of USP 6,849,258) | 508 |
| CD2-1 | CDR-L2 | LVSKLES (Rat Lo-CD2a = BTI-322 from FIG. 31 of USP 6,849,258) | 509 |
| CD2-1 | CDR-L3 | QFTHYPYT (Rat Lo-CD2a = BTI-322 from FIG. 31 of USP 6,849,258) | 510 |
| CD2-1 | VH | EVQLQQSGPELQRPGASVKLSCKASGYIFTEYYMYWVKQR PKQGLELVGRIDPEDGSIDYVEKFKKKATLTADTSSNTAYM QLSSLTSEDTATYFCARGKFNYRFAYWGQGTLVTVSS (SEQ ID NO: 100 of USP 6,849,258) | 511 |
| CD2-1 | VL | DVVLTQTPPTLLATIGQSVSISCRSSQSLLHSSGNTYLNWLL QRTGQSPQPLIYLVSKLESGVPNRFSGSGSGTDFTLKISGV EAEDLGVYYCMQFTHYPYTFGAGTKLELK (Rat Lo-CD2a Vk from SEQ ID NO: 92, without signal sequence as shown in FIG. 31 of USP 6,849,258) | 512 |
| hu1CD2-1 | VH | QVQLVQSGAEVKKPGASVKVSCKASGYTFTEYYMYWVRQ APGQGLELMGRIDPEDGSIDYVEKFKKKVTLTADTSSSTAY MELSSLTSDDTAVYYCARGKFNYRFAYWGQGTLVTVSS (SEQ ID NO: 101 of USP 6,849,258) | 513 |
| | VL | DVVMTQSPPSLLVTLGQPASISCRSSQSLLHSSGNTYLNWL LQRPGQSPQPLIYLVSKLESGVPDRFSGSGSGTDFTLKISG VEAEDVGVYYCMQFTHYPYTFGQGTKLEIK (SEQ ID NO: 96 of USP 6,849,258) | 514 |
| hu2CD2-1 | VH | EVQLQQSGPELQRPGASVKLSCKASGYIFTEYYMYWVKQR PKQGLELVGRIDPEDGSIDYVEKFKKKATLTADTSSNTAYM QLSSLTSEDTATYFCARGKFNYRFAYWGQGTLVTVSS (Vh of MEDI-507; SEQ ID NO: 105 of USP 6,849,258) | 511 |
| | VL | DVVMTQSPPSLLVTLGQPASISCRSSQSLLHSSGNTYLNWL LQRPGQSPQPLIYLVSKLESGVPDRFSGSGSGTDFTLKISG VEAEDVGVYYCMQFTHYPYTFGQGTKLEIK (SEQ ID NO: 96 of USP 6,849,258)(same as hu1CD2-1) | 514 |

In some embodiments, a CD2 ABM comprises the CDR sequences of CD2-1 (SEQ ID NOS: 505-510). In some embodiments, a CD2 ABM comprises the heavy and light chain variable sequences of CD2-1 (SEQ ID NOS: 511-512). In some embodiments, a CD2 ABM comprises the heavy and light chain variable sequences of hu1CD2-1 (SEQ ID NOS: 513-514). In some embodiments, a CD2 ABM comprises the heavy and light chain variable sequences of hu2CD2-1 (SEQ ID NOS: 511 and 514, respectively).

In other embodiments, a CD2 ABM can comprise the CDR sequences of antibody 9D1 produced by the hybridoma deposited with the Chinese Culture Collection Committee General Microbiology Center on May 16, 2012 with accession no. CGMCC 6132, and which is described in CN102827281A. In other embodiments, a CD2 ABM can comprise the CDR sequences of antibody LO-CD2b produced by the hybridoma deposited with the American Type Culture Collection on Jun. 22, 1999 with accession no. PTA-802, and which is described in US 2003/0139579 A1. In yet other embodiments, a CD2 ABM can comprise the CDR sequences of the CD2 SFv-Ig produced by expression of the construct cloned in the recombinant *E. coli* deposited with the ATCC on Apr. 9, 1993 with accession no. 69277, and which is described in U.S. Pat. No. 5,795,572.

In other embodiments, a CD2 ABM can comprise the VH and VL sequences of antibody 9D1. In other embodiments, a CD2 ABM can comprise the VH and VL sequences of antibody LO-CD2b. In yet other embodiments, a CD2 ABM can comprise the VH and VL sequences of the CD2 SFv-Ig produced by expression of the construct cloned in the recombinant *E. coli* having ATCC accession no. 69277.

7.7.2. CD58-Based CD2 ABMs

In certain aspects the present disclosure provides a MBM comprising a CD2 ABM which is a ligand. The CD2 ABM specifically binds to human CD2, whose natural ligand is CD58, also known as LFA-3. CD58/LFA-3 proteins are glycoproteins that are expressed on the surfaces of a variety of cell types (Dustin et al., 1991, Annu. Rev. Immunol. 9:27) and play roles in mediating T-cell interactions with APCs in both antigen-dependent and antigen-independent manners (Wallner et al., 1987, J. Exp. Med. 166:923). Accordingly, in certain aspects, the CD2 ABM is a CD58 moiety. As used herein, a CD58 moiety comprises an amino acid sequence comprising at least 70% sequence identity to a CD2-binding portion of CD58, e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a CD2-binding portion of CD58. The sequence of human CD58 has the Uniprot identifier P19256 (www.uniprot.org/uniprot/P19256). It has been established that CD58 fragments containing amino acid residues 30-123 of full length CD58 (i.e., the sequence designated as CD58-6 in Table 15 below) are sufficient for binding to CD2. Wang et al., 1999, Cell 97:791-803. Accordingly, in certain aspects, a CD58 moiety comprises an amino acid sequence comprising at least 70% sequence identity to amino acids 30-123 of CD58, e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to the amino acid sequence designated CD58-6.

The interactions between CD58 and CD2 have been mapped through x-ray crystallography and molecular modeling. The substitution of residues E25, K29, K30, K32, D33, K34, E37, D84 and K87 (with numbering referring to the in the mature polypeptide) reduces binding to CD2. Ikemizu et al., 1999, Proc. Natl. Acad. Sci. USA 96:4289-94. Accordingly, in some embodiments the CD58 moiety retains the wild type residues at E25, K29, K30, K32, D33, K34, E37, D84 and K87.

In contrast, the following substitutions (with numbering referring to the full length polypeptide) did not impact binding to CD2: F29S; V37K; V49Q; V86K; T113S; and L121G. Accordingly, a CD58 moiety can include one, two, three, four, five or all six of the foregoing substitutions.

In some embodiments, the CD58 moiety is engineered to include a pair of cysteine substitutions that upon recombinant expression create a disulfide bridge. Exemplary amino acid pairs that can be substituted with cysteines in order to form a disulfide bridge upon expression (with numbering referring to the full length polypeptide) are (a) a V45C substitution and a M105C substitution; (b) a V54C substitution and a G88C substitution; (c) a V45C substitution and a M114C substitution; and (d) a W56C substitution and a L90C substitution.

Exemplary CD58 moieties are provided in Table 15 below:

TABLE 15

| CD58 sequences | | | |
|---|---|---|---|
| Name | Description | Sequence | SEQ ID NO: |
| CD58-1 | Full length CD58, including signal sequence and full intracellular domain (P19256) | MVAGSDAGRALGVLSVVCLLHCFGFISCFSQQIYGVVY GNVTFHVPSNVPLKEVLWKKQKDKVAELENSEFRAFS SFKNRVYLDTVSGSLTIYNLTSSDEDEYEMESPNITDTM KFFLYVLESLPSPTLTCALTNGSIEVQCMIPEHYNSHRG LIMYSWDCPMEQCKRNSTSIYFKMENDLPQKIQCTLSN PLFNTTSSIILTTCIPSSGHSRHRYALIPIPLAVITTCIVLY MNGILKCDRKPDRTNSN | 515 |
| CD58-2 | Full length CD58, including signal sequence and but no intracellular domain (P19256-2) | MVAGSDAGRALGVLSVVCLLHCFGFISCFSQQIYGVVY GNVTFHVPSNVPLKEVLWKKQKDKVAELENSEFRAFS SFKNRVYLDTVSGSLTIYNLTSSDEDEYEMESPNITDTM KFFLYVLESLPSPTLTCALTNGSIEVQCMIPEHYNSHRG LIMYSWDCPMEQCKRNSTSIYFKMENDLPQKIQCTLSN PLFNTTSSIILTTCIPSSGHSRHRYALIPIPLAVITTCIVLY MNVL | 516 |

TABLE 15-continued

CD58 sequences

| Name | Description | Sequence | SEQ ID NO: |
|------|-------------|----------|------------|
| CD58-3 | Full length CD58, including signal sequence and variant intracellular domain (P19256-3) | MVAGSDAGRALGVLSVVCLLHCFGFISCFSQQIYGVVY GNVTFHVPSNVPLKEVLWKKQKDKVAELENSEFRAFS SFKNRVYLDTVSGSLTIYNLTSSDEDEYEMESPNITDTM KFFLYVLESLPSPTLTCALTNGSIEVQCMIPEHYNSHRG LIMYSWDCPMEQCKRNSTSIYFKMENDLPQKIQCTLSN PLFNTTSSIILTTCIPSSGHSRHRYALIPIPLAVITTCIVLY MNGILKCDRKPDRTK | 517 |
| CD58-4 | Extracellular domain of CD58, corresponding to amino acids 29-215 of CD58 (WT) | FSQQIYGVVYGNVTFHVPSNVPLKEVLWKKQKDKVAE LENSEFRAFSSFKNRVYLDTVSGSLTIYNLTSSDEDEYE MESPNITDTMKFFLYVLESLPSPTLTCALTNGSIEVQCM IPEHYNSHRGLIMYSWDCPMEQCKRNSTSIYFKMENDL PQKIQCTLSNPLFNTTSSIILTTCIPSSGHSRHR | 518 |
| CD58-5 | Extracellular domain of CD58, corresponding to amino acids 29-215 of CD58 (with permitted substitutions) | BSQQIYGVJYGNVTFHVPSNOPLKEVLWKKQKDK VAELENSEFRAFSSFKNRVYLDTUSGSLTIYNLTS SDEDEYEMESPNITDXMKFFLYVZESLPSPTLTCA LTNGSIEVQCMIPEHYNSHRGLIMYSWDCPMEQC KRNSTSIYFKMENDLPQKIQCTLSNPLFNTTSSIILT TCIPSSGHSRHR<br>B = F or S<br>J = V or K<br>O = V or Q<br>U = V or K<br>X = T or S<br>Z = L or G | 519 |
| CD58-6 | Amino acids 30-123 (WT) Ig-V like domain | SQQIYGVVYGNVTFHVPSNVPLKEVLWKKQKDKVAEL ENSEFRAFSSFKNRVYLDTVSGSLTIYNLTSSDEDEYE MESPNITDTMKFFLYVLES | 520 |
| CD58-7 | Amino acids 30-123 (with permitted substitutions) Ig-V like domain | SQQIYGVJYGNVTFHVPSNOPLKEVLWKKQKDKVAEL ENSEFRAFSSFKNRVYLDTVSGSLTIYNLTSSDEDEYE MESPNITDTMKFFLYVLES<br>J = V or K<br>O = V or Q | 521 |
| CD58-8 | Amino acids 30-123 (V45C_M105C) Ig-V like domain | SQQIYGVVYGNVTFHCPSNVPLKEVLWKKQKDKVAEL ENSEFRAFSSFKNRVYLDTVSGSLTIYNLTSSDEDEYE CESPNITDTMKFFLYVLES | 522 |
| CD58-9 | Amino acids 30-123 (V54C_G88C) Ig-V like domain | SQQIYGVVYGNVTFHVPSNVPLKECLWKKQKDKVAEL ENSEFRAFSSFKNRVYLDTVSCSLTIYNLTSSDEDEYE MESPNITDTMKFFLYVLES | 523 |
| CD58-10 | Amino acids 30-123 (V45C_M114C) Ig-V like domain | SQQIYGVVYGNVTFHCPSNVPLKEVLWKKQKDKVAEL ENSEFRAFSSFKNRVYLDTVSGSLTIYNLTSSDEDEYE MESPNITDTCKFFLYVLES | 524 |
| CD58-11 | Amino acids 30-123 (W56C_L90C) Ig-V like domain | SQQIYGVVYGNVTFHVPSNVPLKEVLCKKQKDKVAELE NSEFRAFSSFKNRVYLDTVSGSCTIYNLTSSDEDEYEM ESPNITDTMKFFLYVLES | 525 |

7.7.3. CD48-Based CD2 ABMs

In certain aspects the present disclosure provides a MBM comprising a CD2 ABM which is CD48 moiety. As used herein, a CD48 moiety comprises an amino acid sequence comprising at least 70% sequence identity to a CD2-binding portion of CD48, e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a CD2-binding portion of CD48. The sequence of human CD48 has the Uniprot identifier P09326 (www.uniprot.org/uniprot/ P09326), which includes a signal peptide (amino acids 1-26) and a GPI anchor (amino acids 221-243). In certain aspects, a CD48 moiety comprises an amino acid sequence comprising at least 70% sequence identity (e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity) to the amino acid sequence consisting of amino acids 27-220 of Uniprot identifier P09326. Human CD48 has an Ig-like O2-type I domain (amino acids 29-127 of Uniprot identifier P09326) and a Ig-like C2 type 2 domain (amino acids 132-212 of Uniprot identifier P09326). Accordingly, in some embodiments, a CD48 moiety comprises an amino acid sequence comprising at least 70% sequence identity (e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity) to the amino acid sequence consisting of amino acids 29-212 of Uniprot identifier P09326, to the O2-type I domain (amino acids 29-127 of Uniprot identifier P09326) and/or to the Ig-like C2 type 2 domain (amino acids 132-212 of Uniprot identifier P09326). A CD48 moiety can in some embodiments comprise one or more natural variants relative to the sequence of Uniprot identifier P09326. For example, a CD48 moiety can include a E102Q substitution.

As another example, a CD48 moiety can comprise an amino acid sequence corresponding to a CD-48 isoform or a CD2 binding portion thereof, e.g., the isoform having Uniprot identifier P09326-2 or a CD2 binding portion thereof.

7.8. Tumor-Associated Antigen ABMs

The MBMs (e.g., TBMs) can comprise an ABM that binds specifically to a tumor-associated antigen (TAA). In some embodiments, the TAA is a human TAA. The antigen may or may not be present on normal cells. In certain embodiments, the TAA is preferentially expressed or upregulated on tumor cells as compared to normal cells. In other embodiments, the TAA is a lineage marker.

In certain embodiments, the TAA is expressed or upregulated on cancerous B cells as compared to normal B cells. In other embodiments, the TAA is a B cell lineage marker.

It is anticipated that any type of B cell malignancy can be targeted by the MBMs of the disclosure. Exemplary types of B cell malignancies that can be targeted include Hodgkin's lymphomas, non-Hodgkin's lymphomas (NHLs), and multiple myeloma. Examples of NHLs include diffuse large B-cell lymphoma (DLBCL), follicular lymphoma, chronic lymphocytic leukemia (CLL)/small lymphocytic lymphoma (SLL), mantle cell lymphoma (MCL), marginal zone lymphomas, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, and primary effusion lymphoma.

Examples of TAAs that can be targeted by the MBMs (e.g., TBMs) include CD19, CD20, CD22, CD123, CD33, CLL1, CD138 (also known as Syndecan-1, SDC1), CS1, CD38, CD133, FLT3, CD52, TNFRSF13C (TNF Receptor Superfamily Member 13C, also referred to in the art as BAFFR: B-Cell-Activating Factor Receptor), TNFRSF13B (TNF Receptor Superfamily Member 13B, also referred to in the art as TACI: Transmembrane Activator And CAML Interactor), CXCR4 (C-X-C Motif Chemokine Receptor 4), PD-L1 (programmed death-ligand 1), LY9 (lymphocyte antigen 9, also referred to in the art as CD229), CD200, FCGR2B (Fc fragment of IgG receptor IIb, also referred to in the art as CD32b), CD21, CD23, CD24, CD40L, CD72, CD79a, and CD79b. In some embodiments, the TAA is CD19. In some embodiments, the TAA is CD20. In some embodiments, the TAA is CD22. In some embodiments, the TAA is CD123. In some embodiments, the TAA is CD33. In some embodiments, the TAA is CLL1. In some embodiments, the TAA is CD138. In some embodiments, the TAA is CS1. In some embodiments, the TAA is CD38. In some embodiments, the TAA is CD133. In some embodiments, the TAA is FLT3. In some embodiments, the TAA is CD52. In some embodiments, the TAA is TNFRSF13C. In some embodiments, the TAA is TNFRSF13B. In some embodiments, the TAA is CXCR4. In some embodiments, the TAA is PD-L1. In some embodiments, the TAA is LY9. In some embodiments, the TAA is CD200. In some embodiments, the TAA is CD21. In some embodiments, the TAA is CD23. In some embodiments, the TAA is CD24. In some embodiments, the TAA is CD40L. In some embodiments, the TAA is CD72. In some embodiments, the TAA is CD79a. In some embodiments, the TAA is CD79b.

A TAA-binding ABM can comprise, for example, an anti-TAA antibody or an antigen-binding fragment thereof. The anti-TAA antibody or antigen-binding fragment can comprise, for example, the CDR sequences of an antibody set forth in Table 16. In some embodiments, the anti-TAA antibody or antigen-binding domain thereof has the heavy and light chain variable region sequences of an antibody set forth in Table 16.

TABLE 16

| Exemplary Anti-Tumor-Associated Antigen Antibodies | |
|---|---|
| Target | Examples of Antibody Name and/or Reference(s) and/or Source |
| CD123 | Any CD123 antibody described in U.S. Pat. No. 8,852,551, EP2426148, WO 2014/138819, WO 2016/028896, or WO 2014/130635 |
| CD19 | Any CD19 antibody described in WO 2014/031687, WO 2012/079000, WO 2014/153270, or U.S. Pat. No. 7,741,465; the CD19 binder of Yescarta or Blinatumomab |
| CD20 | Rituximab, Ofatumumab, Ocrelizumab, Veltuzumab, or GA101 |
| CD22 | Any CD22 antibody described in Haso et al., 2013, Blood, 121(7): 1165-1174, Wayne et al., 2010, Clin Cancer Res 16(6): 1894-1903, Kato et al., 2013, Leuk Res 37(1): 83-88, or Creative BioMart (creativebiomart.net): MOM-18047-S(P). |
| CD33 | Any CD33 antibody described in Bross et al., 2001, Clin Cancer Res 7(6): 1490-1496 (Gemtuzumab Ozogamicin, hP67.6), Caron et al., 1992, Cancer Res 52(24): 6761-6767 (Lintuzumab, HuM195), Lapusan et al., 2012, Invest New Drugs 30(3): 1121-1131 (AVE9633), Aigner et al., 2013, Leukemia 27(5): 1107-1115 (AMG330, CD33 BiTE), Dutour et al., 2012, Adv Hematol 2012: 683065, or Pizzitola et al., 2014, Leukemia doi: 10.1038/Lue.2014.62. |
| CD38 | Daratumumab (see, e.g., Groen et al., 2010, Blood 116(21): 1261-1262; MOR202 (see, e.g., U.S. Pat. No. 8,263,746); or any CD38 antibody described in U.S. Pat. No. 8,362,211. |
| CLL-1 | PE-CLL1-hu Cat# 353604 (BioLegend); PE-CLL1 (CLEC12A) Cat# 562566 (BD); Any CLL-1 antibody described in WO 2014/051433 A1, US 2016/0368994 A1, US 2013/0295118 A1, U.S. Pat. No. 8,536,310 B2, Lu et al., 2014, Angewandte Chemie International Edition 53(37): 9841-9845, or Leong et al., 2017, Blood 129(5): 609-618 |
| CS1 | Elotuzumab (BMS), see e.g., Tai et al., 2008, Blood 112(4): 1329-37; Tai et al., 2007, Blood. 110(5): 1656-63. |
| FLT3 | Any FLT3 antibody described in WO 2011/076922, U.S. Pat. No. 5,777,084, EP0754230, or US 2009/0297529. |

TABLE 16-continued

| | Exemplary Anti-Tumor-Associated Antigen Antibodies |
|---|---|
| Target | Examples of Antibody Name and/or Reference(s) and/or Source |
| CD133 | Any CD133 antibody described in U.S. Pat. No. 9,624,303, WO 2016/154623, or WO 2011/089211; 5E3 (ThermoFisher); MAB11331 (R&D Systems); MAB4310 (Millipore Sigma) |
| CD138 | Any CD138 antibody described in WO/2009/080829, WO/2017/014679, or U.S. Pat. No. 9,289,509; nBT062 (Biotest AG); MI15, B-A38, SP152, DL-101 (ThermoFisher) |
| CD52 | alemtuzumab (Genzyme); ANT1034 (see, Holgate et al., 2015, PLOS ONE 10(9): e0138123; any CD52 antibody described in WO/2010/132659; any CD52 antibody described in U.S. Pat No. 9,708,407; any CD52 antibody described in WO/2010/132659 |
| TNFRSF13C | Any TNFRSF13C antibody described in WO 2010/007082, U.S. Pat. No. 9,382,326 |
| TNFRSF13B | Any TNFRSF13B antibody described in WO 2004/011611; LS-C89973 (Lifespan Biosciences, Inc.) M02952-1 (Boster Biological Technology); MAB1041, MAB1741, and MAB174 (R&D Systems) |
| CXCR4 | Any CXCR4 antibody described in U.S. Pat. Nos. 7,138,496, 8,329,178, 8,450,464, 9,249,223, or 9,260,527 |
| PD-L1 | Any PD-L1 antibody described in US 2015/0203580, US 2017/0058033, US 2017/0204184, U.S. Pat No. 8,741,295, U.S. Pat. No. 9,789,183, or U.S. Pat. No. 9,637,546 |
| LY9 | HLy9.25 (e.g., Lifespan Biosciences, Inc. cat. no. LS-C112605); MAB1898 (R&D Systems) |
| CD200 | Any CD200 antibody described in U.S. Pat. No. 7,887,798; ab23552 (Abcam); Ox104 (ThermoFisher) |
| FCGR2B | Any FCGR2B antibody described in U.S. Pat No. 8,802,089 or WO 2017/103895; ab45143 (Abcam); AT130-2 (ThermoFisher); 2E10 (Millipore Sigma) |
| CD21 | ab75985 (Abcam); ab9492 (Abcam); 2G9 (ThermoFisher); HB5 (ThermoFisher); MAB4909 (R&D Systems) |
| CD23 | Any CD23 antibody described in U.S. Pat. No. 7,008,623 or U.S. Pat. No. 6,011,138; lumiliximab (Biogen); ab16702 (Abcam); SP23 (ThermoFisher) |
| CD24 | Any CD24 antibody described in U.S. Pat. No. 8,614,301; SN3 (ThermoFisher); SN3b (ThermoFisher); 2Q1282 (Santa Cruz Biotechnology); 3H1143 (Santa Cruz Biotechnology); ALB9 (Santa Cruz Biotechnology); MAB5248 (R&D Systems) |
| CD40L | Any CD40L antibody described in U.S. Pat. No. 9,228,018 or US 2003/0099642; 24-31 (Biolegend); ab52750 (Abcam); ab47204 (Abcam); CDP7657 (UCB Pharma); 5e8 (Biogen) |
| CD72 | 3F3 (Biolegend); Bu40 (ThermoFisher); H-7 (Santa Cruz Biotechnology); H-96 (Santa Cruz Biotechnology); G-5 (Santa Cruz Biotechnology); ab92509 (Abcam) |
| CD79a | ab62650 (Abcam); ab79414 (Abcam); MAB69201 (R&D Systems); HM57 (Bio-Rad) |
| CD79b | Any CD79b antibody described in WO 2014/011521; ab130422 (Abcam); ab134147 (Abcam); polatuzumab (Genentech) |

In certain embodiments, the TAA is selected from CD19 and CD20. In some embodiments, the TAA is CD19. CD19 is a human B-cell marker and is found on mature B cells but not on plasma cells. CD19 is expressed during early pre-B cell development and remains until plasma cell differentiation. CD19 is expressed on both normal B cells and cancerous B cells whose abnormal growth can lead to B-cell lymphomas. For example, CD19 is expressed on B-cell lineage cancers, including, but not limited to non-Hodgkin's lymphoma (B-NHL), chronic lymphocytic leukemia, and acute lymphoblastic leukemia.

In certain aspects, a MBM (e.g., a TBM) comprises an ABM3 that specifically binds to CD19. Exemplary CDR and variable domain sequences that can be incorporated into an ABM that specifically binds to CD19 are set forth in Table 17 below.

TABLE 17

| | CD19 Binders | | |
|---|---|---|---|
| Name | Domain | Sequence | SEQ ID NO: |
| CD19-H1 | CDR-H1 | DYGVS | 526 |
| CD19-H2A | CDR-H2 | VIWGSETTYYNSALKS | 527 |
| CD19-H2B | CDR-H2 | VIWGSETTYYSSSLKS | 528 |
| CD19-H2C | CDR-H2 | VIWGSETTYYQSSLKS | 529 |
| CD19-H2D | CDR-H2 | VIWGSETTYYNSSLKS | 530 |
| CD19-H3 | CDR-H3 | HYYYGGSYAMDY | 531 |

TABLE 17-continued

| | | CD19 Binders | |
|---|---|---|---|
| Name | Domain | Sequence | SEQ ID NO: |
| CD19-L1 | CDR-L1 | RASQDISKYLN | 532 |
| CD19-L2 | CDR-L2 | HTSRLHS | 533 |
| CD19-L3 | CDR-L3 | QQGNTLPYT | 534 |
| CD19-VHA | VH | EVKLQESGPGLVAPSQSLSVTCTVSGVSLPDYGVSWI RQPPRKGLEWLGVIWGSETTYYNSALKSRLTIIKDNSK SQVFLKMNSLQTDDTAIYYCAKHYYYGGSYAMDYWG QGTSVTVSS | 535 |
| CD19-VHB | VH | QVQLQESGPGLVKPSETLSLTCTVSGVSLPDYGVSWI RQPPGKGLEWIGVIWGSETTYYSSSLKSRVTISKDNSK NQVSLKLSSVTAADTAVYYCAKHYYYGGSYAMDYWG QGTLVTVSS | 536 |
| CD19-VHC | VH | QVQLQESGPGLVKPSETLSLTCTVSGVSLPDYGVSWI RQPPGKGLEWIGVIWGSETTYYQSSLKSRVTISKDNSK NQVSLKLSSVTAADTAVYYCAKHYYYGGSYAMDYWG QGTLVTVSS | 537 |
| CD19-VHD | VH | QVQLQESGPGLVKPSETLSLTCTVSGVSLPDYGVSWI RQPPGKGLEWIGVIWGSETTYYNSSLKSRVTISKDNSK NQVSLKLSSVTAADTAVYYCAKHYYYGGSYAMDYWG QGTLVTVSS | 538 |
| CD19-VLA | VL | DIQMTQTTSSLSASLGDRVTISCRASQDISKYLNWYQQ KPDGTVKLLIYHTSRLHSGVPSRFSGSGSGTDYSLTIS NLEQEDIATYFCQQGNTLPYTFGGGTKLEIT | 539 |
| CD19-VLB | VL | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIK | 540 |
| CD19-scFv1 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCTVSGVS LPDYGVSWIRQPPGKGLEWIGVIWGSETTYYSSSLKS RVTISKDNSKNQVSLKLSSVTAADTAVYYCAKHYYYGG SYAMDYWGQGTLVTVSS | 541 |
| CD19-scFv2 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCTVSGVS LPDYGVSWIRQPPGKGLEWIGVIWGSETTYYQSSLKS RVTISKDNSKNQVSLKLSSVTAADTAVYYCAKHYYYGG SYAMDYWGQGTLVTVSS | 542 |
| CD19-scFv3 | scFv | QVQLQESGPGLVKPSETLSLTCTVSGVSLPDYGVSWI RQPPGKGLEWIGVIWGSETTYYSSSLKSRVTISKDNSK NQVSLKLSSVTAADTAVYYCAKHYYYGGSYAMDYWG QGTLVTVSSGGGGSGGGGSGGGGSEIVMTQSPATLS LSPGERATLSCRASQDISKYLNWYQQKPGQAPRLLIYH TSRLHSGIPARFSGSGSGTDYTLTISSLQPEDFAVYFC QQGNTLPYTFGQGTKLEIK | 543 |
| CD19-scFv4 | scFv | QVQLQESGPGLVKPSETLSLTCTVSGVSLPDYGVSWI RQPPGKGLEWIGVIWGSETTYYQSSLKSRVTISKDNSK NQVSLKLSSVTAADTAVYYCAKHYYYGGSYAMDYWG QGTLVTVSSGGGGSGGGGSGGGGSEIVMTQSPATLS LSPGERATLSCRASQDISKYLNWYQQKPGQAPRLLIYH TSRLHSGIPARFSGSGSGTDYTLTISSLQPEDFAVYFC QQGNTLPYTFGQGTKLEIK | 544 |
| CD19-scFv5 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSGGGGSQVQLQESGPGLVKPSETLSLTCT VSGVSLPDYGVSWIRQPPGKGLEWIGVIWGSETTYYS SSLKSRVTISKDNSKNQVSLKLSSVTAADTAVYYCAKH YYYGGSYAMDYWGQGTLVTVSS | 545 |

US 12,624,118 B2

327 328

TABLE 17-continued

CD19 Binders

| Name | Domain | Sequence | SEQ ID NO: |
|---|---|---|---|
| CD19-scFv6 | scFv | EIVMTQSPATLSLSPGERATLSCRASQDISKYLNWYQQ<br>KPGQAPRLLIYHTSRLHSGIPARFSGSGSGTDYTLTISS<br>LQPEDFAVYFCQQGNTLPYTFGQGTKLEIKGGGGSGG<br>GGSGGGGSGGGGSQVQLQESGPGLVKPSETLSLTCT<br>VSGVSLPDYGVSWIRQPPGKGLEWIGVIWGSETTYYQ<br>SSLKSRVTISKDNSKNQVSLKLSSVTAADTAVYYCAKH<br>YYYGGSYAMDYWGQGTLVTVSS | 546 |
| CD19-scFv7 | scFv | QVQLQESGPGLVKPSETLSLTCTVSGVSLPDYGVSWI<br>RQPPGKGLEWIGVIWGSETTYYSSSLKSRVTISKDNSK<br>NQVSLKLSSVTAADTAVYYCAKHYYYGGSYAMDYWG<br>QGTLVTVSSGGGGSGGGGSGGGGSGGGGSEIVMTQ<br>SPATLSLSPGERATLSCRASQDISKYLNWYQQKPGQA<br>PRLLIYHTSRLHSGIPARFSGSGSGTDYTLTISSLQPED<br>FAVYFCQQGNTLPYTFGQGTKLEIK | 547 |
| CD19-scFv8 | scFv | QVQLQESGPGLVKPSETLSLTCTVSGVSLPDYGVSWI<br>RQPPGKGLEWIGVIWGSETTYYQSSLKSRVTISKDNSK<br>NQVSLKLSSVTAADTAVYYCAKHYYYGGSYAMDYWG<br>QGTLVTVSSGGGGSGGGGSGGGGSGGGGSEIVMTQ<br>SPATLSLSPGERATLSCRASQDISKYLNWYQQKPGQA<br>PRLLIYHTSRLHSGIPARFSGSGSGTDYTLTISSLQPED<br>FAVYFCQQGNTLPYTFGQGTKLEIK | 548 |
| CD19-scFv9 | scFv | EIVMTQSPATLSLSPGERATLSCRASQDISKYLNWYQQ<br>KPGQAPRLLIYHTSRLHSGIPARFSGSGSGTDYTLTISS<br>LQPEDFAVYFCQQGNTLPYTFGQGTKLEIKGGGGSGG<br>GGSGGGGSGGGGSQVQLQESGPGLVKPSETLSLTCT<br>VSGVSLPDYGVSWIRQPPGKGLEWIGVIWGSETTYYN<br>SSLKSRVTISKDNSKNQVSLKLSSVTAADTAVYYCAKH<br>YYYGGSYAMDYWGQGTLVTVSS | 549 |
| CD19-scFv10 | scFv | QVQLQESGPGLVKPSETLSLTCTVSGVSLPDYGVSWI<br>RQPPGKGLEWIGVIWGSETTYYNSSLKSRVTISKDNSK<br>NQVSLKLSSVTAADTAVYYCAKHYYYGGSYAMDYWG<br>QGTLVTVSSGGGGSGGGGSGGGGSGGGGSEIVMTQ<br>SPATLSLSPGERATLSCRASQDISKYLNWYQQKPGQA<br>PRLLIYHTSRLHSGIPARFSGSGSGTDYTLTISSLQPED<br>FAVYFCQQGNTLPYTFGQGTKLEIK | 550 |
| CD19-scFv11 | scFv | EIVMTQSPATLSLSPGERATLSCRASQDISKYLNWYQQ<br>KPGQAPRLLIYHTSRLHSGIPARFSGSGSGTDYTLTISS<br>LQPEDFAVYFCQQGNTLPYTFGQGTKLEIKGGGGSGG<br>GGSGGGGSQVQLQESGPGLVKPSETLSLTCTVSGVS<br>LPDYGVSWIRQPPGKGLEWIGVIWGSETTYYNSSLKS<br>RVTISKDNSKNQVSLKLSSVTAADTAVYYCAKHYYYGG<br>SYAMDYWGQGTLVTVSS | 551 |
| CD19-scFv12 | scFv | QVQLQESGPGLVKPSETLSLTCTVSGVSLPDYGVSWI<br>RQPPGKGLEWIGVIWGSETTYYNSSLKSRVTISKDNSK<br>NQVSLKLSSVTAADTAVYYCAKHYYYGGSYAMDYWG<br>QGTLVTVSSGGGGSGGGGSGGGGSEIVMTQSPATLS<br>LSPGERATLSCRASQDISKYLNWYQQKPGQAPRLLIYH<br>TSRLHSGIPARFSGSGSGTDYTLTISSLQPEDFAVYFC<br>QQGNTLPYTFGQGTKLEIK | 552 |

In certain aspects, ABM3 comprises heavy chain CDRs having the amino acid sequences of CD19-H1, CD19-H2A, and CD19-H3 as set forth in Table 17 and light chain CDRs having the amino acid sequences of CD19-L1, CD19-L2, and CD19-L3 as set forth in Table 17. In an embodiment, ABM3 comprises a heavy chain variable region having the amino acid sequences of VHA as set forth in Table 17 and a light chain variable region having the amino acid sequences of VLA as set forth in Table 17.

In other aspects, ABM3 comprises heavy chain CDRs having the amino acid sequences of CD19-H1, CD19-H2B, and CD19-H3 as set forth in Table 17 and light chain CDRs having the amino acid sequences of CD19-L1, CD19-L2, and CD19-L3 as set forth in Table 17. In an embodiment, ABM3 comprises a heavy chain variable region having the amino acid sequences of VHB as set forth in Table 17 and a light chain variable region having the amino acid sequences of VLB as set forth in Table 17.

In further aspects, ABM3 comprises heavy chain CDRs having the amino acid sequences of CD19-H1, CD19-H2C, and CD19-H3 as set forth in Table 17 and light chain CDRs having the amino acid sequences of CD19-L1, CD19-L2, and CD19-L3 as set forth in Table 17. In an embodiment, ABM3 comprises a heavy chain variable region having the amino acid sequences of VHC as set forth in Table 17 and a light chain variable region having the amino acid sequences of VLB as set forth in Table 17.

In further aspects, ABM3 comprises heavy chain CDRs having the amino acid sequences of CD19-H1, CD19-H2D, and CD19-H3 as set forth in Table 17 and light chain CDRs having the amino acid sequences of CD19-L1, CD19-L2, and CD19-L3 as set forth in Table 17. In an embodiment, ABM3 comprises a heavy chain variable region having the amino acid sequences of VHD as set forth in Table 17 and a light chain variable region having the amino acid sequences of VLB as set forth in Table 17.

In yet further aspects, ABM3 is in the form of an scFV. Exemplary anti-CD19 scFvs comprise the amino acid sequence of any one of CD19-scFv1 through CD19-scFv12 as set forth in Table 17.

7.9. Nucleic Acids and Host Cells

In another aspect, the disclosure provides nucleic acids (i.e., polynucleotides) encoding the MBMs (e.g., TBMs) of the disclosure. In some embodiments, the MBMs are encoded by a single nucleic acid. In other embodiments, the MBMs are encoded by a plurality (e.g., two, three, four or more) nucleic acids.

A single nucleic acid can encode a MBM that comprises a single polypeptide chain, a MBM that comprises two or more polypeptide chains, or a portion of a MBM that comprises more than two polypeptide chains (for example, a single nucleic acid can encode two polypeptide chains of a TBM comprising three, four or more polypeptide chains, or three polypeptide chains of a TBM comprising four or more polypeptide chains). For separate control of expression, the open reading frames encoding two or more polypeptide chains can be under the control of separate transcriptional regulatory elements (e.g., promoters and/or enhancers). The open reading frames encoding two or more polypeptides can also be controlled by the same transcriptional regulatory elements, and separated by internal ribosome entry site (IRES) sequences allowing for translation into separate polypeptides.

In some embodiments, a MBM comprising two or more polypeptide chains is encoded by two or more nucleic acids. The number of nucleic acids encoding a MBM can be equal to or less than the number of polypeptide chains in the MBM (for example, when more than one polypeptide chains are encoded by a single nucleic acid).

The nucleic acids can be DNA or RNA (e.g., mRNA).

In another aspect, the disclosure provides host cells and vectors containing the nucleic acids of the disclosure. The nucleic acids can be present in a single vector or separate vectors present in the same host cell or separate host cell, as described in more detail herein below.

7.9.1. Vectors

The disclosure provides vectors comprising nucleotide sequences encoding a MBM (e.g., a TBM) or a MBM component described herein. In one embodiment, the vectors comprise nucleotides encoding an immunoglobulin-based ABM described herein. In one embodiment, the vectors comprise nucleotides encoding an Fc domain described herein. In one embodiment, the vectors comprise nucleotides encoding a recombinant non-immunoglobulin based ABM described herein. A vector can encode one or more ABMs, one or more Fc domains, one or more non-immunoglobulin based ABM, or any combination thereof (e.g., when multiple components or sub-components are encoded as a single polypeptide chain). In one embodiment, the vectors comprise the nucleotide sequences described herein. The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes can be selected by introducing one or more markers which allow for the selection of transfected host cells. The marker can provide, for example, prototropy to an auxotrophic host, biocide resistance (e.g., antibiotics), or resistance to heavy metals such as copper, or the like. The selectable marker gene can be either directly linked to the DNA sequences to be expressed, or introduced into the same cell by cotransformation. Additional elements may also be needed for optimal synthesis of mRNA. These elements can include splice signals, as well as transcriptional promoters, enhancers, and termination signals.

Once the expression vector or DNA sequence containing the constructs has been prepared for expression, the expression vectors can be transfected or introduced into an appropriate host cell. Various techniques can be employed to achieve this, such as, for example, protoplast fusion, calcium phosphate precipitation, electroporation, retroviral transduction, viral transfection, gene gun, lipid based transfection or other conventional techniques. Methods and conditions for culturing the resulting transfected cells and for recovering the expressed polypeptides are known to those skilled in the art, and can be varied or optimized depending upon the specific expression vector and mammalian host cell employed, based upon the present description.

7.9.2. Cells

The disclosure also provides host cells comprising a nucleic acid of the disclosure.

In one embodiment, the host cells are genetically engineered to comprise one or more nucleic acids described herein.

In one embodiment, the host cells are genetically engineered by using an expression cassette. The phrase "expression cassette," refers to nucleotide sequences, which are capable of affecting expression of a gene in hosts compatible with such sequences. Such cassettes can include a promoter, an open reading frame with or without introns, and a termination signal. Additional factors necessary or helpful in effecting expression can also be used, such as, for example, an inducible promoter.

The disclosure also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

7.10. Antibody-Drug Conjugates

The MBMs (e.g., TBMs) can be conjugated, e.g., via a linker, to a drug moiety. Such conjugates are referred to herein as antibody-drug conjugates (or "ADCs") for convenience, notwithstanding the fact that one or more (or all) of the ABMs might be based on non-immunoglobulin scaffolds.

In certain aspects, the drug moiety exerts a cytotoxic or cytostatic activity. In one embodiment, the drug moiety is chosen from a maytansinoid, a kinesin-like protein KIF11 inhibitor, a V-ATPase (vacuolar-type H+-ATPase) inhibitor, a pro-apoptotic agent, a Bcl2 (B-cell lymphoma 2) inhibitor, an MCL1 (myeloid cell leukemia 1) inhibitor, a HSP90 (heat shock protein 90) inhibitor, an IAP (inhibitor of apoptosis) inhibitor, an mTOR (mechanistic target of rapamycin) inhibitor, a microtubule stabilizer, a microtubule destabilizer, an auristatin, a dolastatin, a MetAP (methionine aminopeptidase), a CRM1 (chromosomal maintenance 1) inhibitor, a DPPIV (dipeptidyl peptidase IV) inhibitor, a proteasome inhibitor, an inhibitor of a phosphoryl transfer reaction in mitochondria, a protein synthesis inhibitor, a kinase inhibitor, a CDK2 (cyclin-dependent kinase 2) inhibitor, a CDK9 (cyclin-dependent kinase 9) inhibitor, a kinesin inhibitor, an HDAC (histone deacetylase) inhibitor, a DNA damaging agent, a DNA alkylating agent, a DNA intercalator, a DNA minor groove binder, a RNA polymerase inhibitor, a topoisomerase inhibitor, or a DHFR (dihydrofolate reductase) inhibitor.

In one embodiment, the linker is chosen from a cleavable linker, a non-cleavable linker, a hydrophilic linker, a procharged linker, or a dicarboxylic acid based linker.

In some embodiments, the ADCs are compounds according to structural formula (I):

[D-L-XY]$_n$-Ab or salts thereof, where each "D" represents, independently of the others, a cytotoxic and/or cytostatic agent ("drug"); each "L" represents, independently of the others, a linker; "Ab" represents a MBM described herein; each "XY" represents a linkage formed between a functional group $R^x$ on the linker and a "complementary" functional group $R^y$ on the antibody, and n represents the number of drugs linked to, or drug-to-antibody ratio (DAR), of the ADC.

Some embodiments of the various antibodies (Ab) that can comprise the ADCs include the various embodiments of MBMs described above.

In some embodiments of the ADCs and/or salts of structural formula (I), each D is the same and/or each L is the same.

Some embodiments of cytotoxic and/or cytostatic agents (D) and linkers (L) that can comprise the ADCs of the disclosure, as well as the number of cytotoxic and/or cytostatic agents linked to the ADCs, are described in more detail below.

7.10.1. Cytotoxic and/or Cytostatic Agents

The cytotoxic and/or cytostatic agents can be any agents known to inhibit the growth and/or replication of and/or kill cells, and in particular cancer and/or tumor cells. Numerous agents having cytotoxic and/or cytostatic properties are known in the literature. Non-limiting examples of classes of cytotoxic and/or cytostatic agents include, by way of example and not limitation, radionuclides, alkylating agents, topoisomerase I inhibitors, topoisomerase II inhibitors, DNA intercalating agents (e.g., groove binding agents such as minor groove binders), RNA/DNA antimetabolites, cell cycle modulators, kinase inhibitors, protein synthesis inhibitors, histone deacetylase inhibitors, mitochondria inhibitors, and antimitotic agents.

Specific non-limiting examples of agents within certain of these various classes are provided below.

Alkylatinq Agents: asaley ((L-Leucine, N—[N-acetyl-4-[bis-(2-chloroethyl)amino]-DL-phenylalanyl]-, ethylester; NSC 167780; CAS Registry No. 3577897)); AZQ ((1,4-cyclohexadiene-1,4-dicarbamic acid, 2,5-bis(1-aziridinyl)-3,6-dioxo-, diethyl ester; NSC 182986; CAS Registry No. 57998682)); BCNU ((N,N'-Bis(2-chloroethyl)-N-nitrosourea; NSC 409962; CAS Registry No. 154938)); busulfan (1,4-butanediol dimethanesulfonate; NSC 750; CAS Registry No. 55981); (carboxyphthalato)platinum (NSC 27164; CAS Registry No. 65296813); CBDCA ((cis-(1,1-cyclobutanedicarboxylato)diammineplatinum(II)); NSC 241240; CAS Registry No. 41575944)); CCNU ((N-(2-chloroethyl)-N'-cyclohexyl-N-nitrosourea; NSC 79037; CAS Registry No. 13010474)); CHIP (iproplatin; NSC 256927); chlorambucil (NSC 3088; CAS Registry No. 305033); chlorozotocin ((2-[[[(2-chloroethyl) nitrosoamino] carbonyl]amino]-2-deoxy-D-glucopyranose; NSC 178248; CAS Registry No. 54749905)); cis-platinum (cisplatin; NSC 119875; CAS Registry No. 15663271); clomesone (NSC 338947; CAS Registry No. 88343720); cyanomorpholino-doxorubicin (NCS 357704; CAS Registry No. 88254073); cyclodisone (NSC 348948; CAS Registry No. 99591738); dianhydrogalactitol (5,6-diepoxydulcitol; NSC 132313; CAS Registry No. 23261203); fluorodopan ((5-[(2-chloro-ethyl)-(2-fluoroethyl)amino]-6-methyl-uracil; NSC 73754; CAS Registry No. 834913); hepsulfam (NSC 329680; CAS Registry No. 96892578); hycanthone (NSC 142982; CAS Registry No. 23255938); melphalan (NSC 8806; CAS Registry No. 3223072); methyl CCNU ((1-(2-chloroethyl)-3-(trans-4-methylcyclohexane)-1-nitrosourea; NSC 95441; 13909096); mitomycin C (NSC 26980; CAS Registry No. 50077); mitozolamide (NSC 353451; CAS Registry No. 85622953); nitrogen mustard ((bis(2-chloroethyl)methylamine hydrochloride; NSC 762; CAS Registry No. 55867); PCNU ((1-(2-chloroethyl)-3-(2,6-dioxo-3-piperidyl)-1-nitrosourea; NSC 95466; CAS Registry No. 13909029)); piperazine alkylator ((1-(2-chloroethyl)-4-(3-chloropropyl)-piperazine dihydrochloride; NSC 344007)); piperazinedione (NSC 135758; CAS Registry No. 41109802); pipobroman ((N,N-bis(3-bromopropionyl) piperazine; NSC 25154; CAS Registry No. 54911)); porfiromycin (N-methylmitomycin C; NSC 56410; CAS Registry No. 801525); spirohydantoin mustard (NSC 172112; CAS Registry No. 56605164); teroxirone (triglycidylisocyanurate; NSC 296934; CAS Registry No. 2451629); tetraplatin (NSC 363812; CAS Registry No. 62816982); thio-tepa (N,N',N"-tri-1,2-ethanediylthio phosphoramide; NSC 6396; CAS Registry No. 52244); triethylenemelamine (NSC 9706; CAS Registry No. 51183); uracil nitrogen mustard (desmethyldopan; NSC 34462; CAS Registry No. 66751); Yoshi-864 ((bis(3-mesyloxy propyl)amine hydrochloride; NSC 102627; CAS Registry No. 3458228).

Topoisomerase I Inhibitors: camptothecin (NSC 94600; CAS Registry No. 7689-03-4); various camptothecin derivatives and analogs (for example, NSC 100880, NSC 603071, NSC 107124, NSC 643833, NSC 629971, NSC 295500, NSC 249910, NSC 606985, NSC 74028, NSC 176323, NSC 295501, NSC 606172, NSC 606173, NSC 610458, NSC 618939, NSC 610457, NSC 610459, NSC 606499, NSC 610456, NSC 364830, and NSC 606497); morpholinisoxorubicin (NSC 354646; CAS Registry No. 89196043); SN-38 (NSC 673596; CAS Registry No. 86639-52-3).

Topoisomerase II Inhibitors: doxorubicin (NSC 123127; CAS Registry No. 25316409); amonafide (benzisoquinolinedione; NSC 308847; CAS Registry No. 69408817); m-AMSA ((4'-(9-acridinylamino)-3'-methoxymethanesulfonanilide; NSC 249992; CAS Registry No. 51264143)); anthrapyrazole derivative ((NSC 355644); etoposide (VP- 16; NSC 141540; CAS Registry No. 33419420); pyrazolo-acridine ((pyrazolo[3,4,5-kl]acridine-2(6H)-propanamine, 9-methoxy-N, N-dimethyl-5-nitro-, monomethanesulfonate; NSC 366140; CAS Registry No. 99009219); bisantrene hydrochloride (NSC 337766; CAS Registry No. 71439684); daunorubicin (NSC 821151; CAS Registry No. 23541506); deoxydoxorubicin (NSC 267469; CAS Registry No. 63950061); mitoxantrone (NSC 301739; CAS Registry No. 70476823); menogaril (NSC 269148; CAS Registry No. 71628961); N,N-dibenzyl daunomycin (NSC 268242; CAS Registry No. 70878512); oxanthrazole (NSC 349174; CAS Registry No. 105118125); rubidazone (NSC 164011; CAS Registry No. 36508711); teniposide (VM-26; NSC 122819; CAS Registry No. 29767202).

DNA Intercalating Agents: anthramycin (CAS Registry No. 4803274); chicamycin A (CAS Registry No. 89675376); tomaymycin (CAS Registry No. 35050556); DC-81 (CAS Registry No. 81307246); sibiromycin (CAS Registry No. 12684332); pyrrolobenzodiazepine derivative (CAS Registry No. 945490095); SGD-1882 ((S)-2-(4-aminophenyl)-7-methoxy-8-(3-4(S)-7-methoxy-2-(4-methoxyphenyl)-5-oxo-5,11a-dihydro-1H-benzo[e]pyrrolo[1,2-[1,2-a][1,4]diazepin-8-yl)oxy)propox-y)-1H-benzo[e]pyrrolo[1,2-a][1,4]diazepin-5(11aH)-one); SG2000 (SJG-136; (11a'S,11a'S)-8,8'-(propane-1,3-diylbis(oxy))bis(7-methoxy-2-methylene-2,3-dihydro-1H-benzo[e]pyrrolo[1,2-a][1,4]diazepin-5(11aH)-one); NSC 694501; CAS Registry No. 232931576).

RNA/DNA Antimetabolites: L-alanosine (NSC 153353; CAS Registry No. 59163416); 5-azacytidine (NSC 102816; CAS Registry No. 320672); 5-fluorouracil (NSC 19893; CAS Registry No. 51218); acivicin (NSC 163501; CAS Registry No. 42228922); aminopterin derivative N-[2-chloro-5-[[(2,4-diamino-5-methyl-6-quinazolinyl)methyl]amino]benzoyl-]L-aspartic acid (NSC 132483); aminopterin derivative N44-[[(2,4-diamino-5-ethyl-6-quinazolinyl)methyl]amino]benzoyl]L-asparti-c acid (NSC 184692); aminopterin derivative N-[2-chloro-4-[[(2,4-diamino-6-pte-ridinyl)methyl]amino]benzoyl]L-aspartic acid monohydrate (NSC 134033); an antifo ((N$^\alpha$-(4-amino-4-deoxypteroyl)-N$^7$-hemiphthaloyl-L-ornithin-e; NSC 623017)); Baker's soluble antifol (NSC 139105; CAS Registry No. 41191042); dichlorallyl lawsone ((2-(3,3-dichloroallyl)-3-hydroxy-1,4-naphthoquinone; NSC 126771; CAS Registry No. 36417160); brequinar (NSC 368390; CAS Registry No. 96201886); ftorafur ((pro-drug; 5-fluoro-1-(tetrahydro-2-fu-ryl)-uracil; NSC 148958; CAS Registry No. 37076689); 5,6-dihydro-5-azacytidine (NSC 264880; CAS Registry No. 62402317); methotrexate (NSC 740; CAS Registry No. 59052); methotrexate derivative (N-[[4-[[(2,4-diamino-6-pteridinyl)methyl]methylamino]-1-naphthalenyl]car-bonyl] L-glutamic acid; NSC 174121); PALA ((N-(phosphono-acetyl)-L-aspartate; NSC 224131; CAS Registry No. 603425565); pyrazofurin (NSC 143095; CAS Registry No. 30868305); trimetrexate (NSC 352122; CAS Registry No. 82952645).

DNA Antimetabolites: 3-HP (NSC 95678; CAS Registry No. 3814797); 2'-deoxy-5-fluorouridine (NSC 27640; CAS Registry No. 50919); 5-HP (NSC 107392; CAS Registry No. 19494894); α-TGDR (α-2'-deoxy-6-thioguanosine; NSC 71851 CAS Registry No. 2133815); aphidicolin glycinate (NSC 303812; CAS Registry No. 92802822); ara C (cyto-sine arabinoside; NSC 63878; CAS Registry No. 69749); 5-aza-2'-deoxycytidine (NSC 127716; CAS Registry No. 2353335); β-TGDR (β-2'-deoxy-6-thioguanosine; NSC 71261; CAS Registry No. 789617); cyclocytidine (NSC 145668; CAS Registry No. 10212256); guanazole (NSC 1895; CAS Registry No. 1455772); hydroxyurea (NSC 32065; CAS Registry No. 127071); inosine glycodialdehyde (NSC 118994; CAS Registry No. 23590990); macbecin II (NSC 330500; CAS Registry No. 73341738); pyrazoloimi-dazole (NSC 51143; CAS Registry No. 6714290); thiogua-nine (NSC 752; CAS Registry No. 154427); thiopurine (NSC 755; CAS Registry No. 50442).

Cell Cycle Modulators: silibinin (CAS Registry No. 22888-70-6); epigallocatechin gallate (EGCG; CAS Regis-try No. 989515); procyanidin derivatives (e.g., procyanidin A1 [CAS Registry No. 103883030], procyanidin B1 [CAS Registry No. 20315257], procyanidin B4 [CAS Registry No. 29106512], arecatannin B1 [CAS Registry No. 79763283]); isoflavones (e.g., genistein [4',5,7-trihydroxyisoflavone; CAS Registry No. 446720], daidzein [4',7-dihydroxyisofla-vone, CAS Registry No. 486668]; indole-3-carbinol (CAS Registry No. 700061); quercetin (NSC 9219; CAS Registry No. 117395); estramustine (NSC 89201; CAS Registry No. 2998574); nocodazole (CAS Registry No. 31430189); podo-phyllotoxin (CAS Registry No. 518285); vinorelbine tartrate (NSC 608210; CAS Registry No. 125317397); cryptophycin (NSC 667642; CAS Registry No. 124689652).

Kinase Inhibitors: afatinib (CAS Registry No. 850140726); axitinib (CAS Registry No. 319460850); ARRY-438162 (binimetinib) (CAS Registry No. 606143899); bosutinib (CAS Registry No. 380843754); cabozantinib (CAS Registry No. 1140909483); ceritinib (CAS Registry No. 1032900256); crizotinib (CAS Registry No. 877399525); dabrafenib (CAS Registry No. 1195765457); dasatinib (NSC 732517; CAS Registry No. 302962498); erlotinib (NSC 718781; CAS Registry No. 183319699); everolimus (NSC 733504; CAS Registry No. 159351696); fostamatinib (NSC 745942; CAS Registry No. 901119355); gefitinib (NSC 715055; CAS Registry No. 184475352); ibrutinib (CAS Registry No. 936563961); ima-tinib (NSC 716051; CAS Registry No. 220127571); lapa-tinib (CAS Registry No. 388082788); lenvatinib (CAS Reg-istry No. 857890392); mubritinib (CAS 366017096); nilotinib (CAS Registry No. 923288953); nintedanib (CAS Registry No. 656247175); palbociclib (CAS Registry No. 571190302); pazopanib (NSC 737754; CAS Registry No. 635702646); pegaptanib (CAS Registry No. 222716861); ponatinib (CAS Registry No. 1114544318); rapamycin (NSC 226080; CAS Registry No. 53123889); regorafenib (CAS Registry No. 755037037); AP 23573 (ridaforolimus) (CAS Registry No. 572924540); INCB018424 (ruxolitinib) (CAS Registry No. 1092939177); ARRY-142886 (selume-tinib) (NSC 741078; CAS Registry No. 606143-52-6); siro-limus (NSC 226080; CAS Registry No. 53123889); sorafenib (NSC 724772; CAS Registry No. 475207591); sunitinib (NSC 736511; CAS Registry No. 341031547); tofacitinib (CAS Registry No. 477600752); temsirolimus (NSC 683864; CAS Registry No. 163635043); trametinib (CAS Registry No. 871700173); vandetanib (CAS Registry No. 443913733); vemurafenib (CAS Registry No. 918504651); SU6656 (CAS Registry No. 330161870); CEP-701 (lesaurtinib) (CAS Registry No. 111358884); XL019 (CAS Registry No. 945755566); PD-325901 (CAS Registry No. 391210109); PD-98059 (CAS Registry No. 167869218); ATP-competitive TORC1/TORC2 inhibitors including PI-103 (CAS Registry No. 371935749), PP242 (CAS Registry No. 1092351671), PP30 (CAS Registry No. 1092788094), Torin 1 (CAS Registry No. 1222998368), LY294002 (CAS Registry No. 154447366), XL-147 (CAS Registry No. 934526893), CAL-120 (CAS Registry No. 870281348), ETP-45658 (CAS Registry No. 1198357797), PX 866 (CAS Registry No. 502632668), GDC-0941 (CAS Registry No. 957054307), BGT226 (CAS Registry No.

1245537681), BEZ235 (CAS Registry No. 915019657), XL-765 (CAS Registry No. 934493762).

Protein Synthesis Inhibitors: acriflavine (CAS Registry No. 65589700); amikacin (NSC 177001; CAS Registry No. 39831555); arbekacin (CAS Registry No. 51025855); astromicin (CAS Registry No. 55779061); azithromycin (NSC 643732; CAS Registry No. 83905015); bekanamycin (CAS Registry No. 4696768); chlortetracycline (NSC 13252; CAS Registry No. 64722); clarithromycin (NSC 643733; CAS Registry No. 81103119); clindamycin (CAS Registry No. 18323449); clomocycline (CAS Registry No. 1181540); cycloheximide (CAS Registry No. 66819); dactinomycin (NSC 3053; CAS Registry No. 50760); dalfopristin (CAS Registry No. 112362502); demeclocycline (CAS Registry No. 127333); dibekacin (CAS Registry No. 34493986); dihydrostreptomycin (CAS Registry No. 128461); dirithromycin (CAS Registry No. 62013041); doxycycline (CAS Registry No. 17086281); emetine (NSC 33669; CAS Registry No. 483181); erythromycin (NSC 55929; CAS Registry No. 114078); flurithromycin (CAS Registry No. 83664208); framycetin (neomycin B; CAS Registry No. 119040); gentamycin (NSC 82261; CAS Registry No. 1403663); glycylcyclines, such as tigecycline (CAS Registry No. 220620097); hygromycin B (CAS Registry No. 31282049); isepamicin (CAS Registry No. 67814760); josamycin (NSC 122223; CAS Registry No. 16846245); kanamycin (CAS Registry No. 8063078); ketolides such as telithromycin (CAS Registry No. 191114484), cethromycin (CAS Registry No. 205110481), and solithromycin (CAS Registry No. 760981837); lincomycin (CAS Registry No. 154212); lymecycline (CAS Registry No. 992212); meclocycline (NSC 78502; CAS Registry No. 2013583); metacycline (rondomycin; NSC 356463; CAS Registry No. 914001); midecamycin (CAS Registry No. 35457808); minocycline (NSC 141993; CAS Registry No. 10118908); miocamycin (CAS Registry No. 55881077); neomycin (CAS Registry No. 119040); netilmicin (CAS Registry No. 56391561); oleandomycin (CAS Registry No. 3922905); oxazolidinones, such as eperezolid (CAS Registry No. 165800044), linezolid (CAS Registry No. 165800033), posizolid (CAS Registry No. 252260029), radezolid (CAS Registry No. 869884786), ranbezolid (CAS Registry No. 392659380), sutezolid (CAS Registry No. 168828588), tedizolid (CAS Registry No. 856867555); oxytetracycline (NSC 9169; CAS Registry No. 2058460); paromomycin (CAS Registry No. 7542372); penimepicycline (CAS Registry No. 4599604); peptidyl transferase inhibitors, e.g., chloramphenicol (NSC 3069; CAS Registry No. 56757) and derivatives such as azidamfenicol (CAS Registry No. 13838089), florfenicol (CAS Registry No. 73231342), and thiamphenicol (CAS Registry No. 15318453), and pleuromutilins such as retapamulin (CAS Registry No. 224452668), tiamulin (CAS Registry No. 55297955), valnemulin (CAS Registry No. 101312929); pirlimycin (CAS Registry No. 79548735); puromycin (NSC 3055; CAS Registry No. 53792); quinupristin (CAS Registry No. 120138503); ribostamycin (CAS Registry No. 53797356); rokitamycin (CAS Registry No. 74014510); rolitetracycline (CAS Registry No. 751973); roxithromycin (CAS Registry No. 80214831); sisomicin (CAS Registry No. 32385118); spectinomycin (CAS Registry No. 1695778); spiramycin (CAS Registry No. 8025818); streptogramins such as pristinamycin (CAS Registry No. 270076603), quinupristin/dalfopristin (CAS Registry No. 126602899), and virginiamycin (CAS Registry No. 11006761); streptomycin (CAS Registry No. 57921); tetracycline (NSC 108579; CAS Registry No. 60548); tobramycin (CAS Registry No.

32986564); troleandomycin (CAS Registry No. 2751099); tylosin (CAS Registry No. 1401690); verdamicin (CAS Registry No. 49863481).

Histone Deacetylase Inhibitors: abexinostat (CAS Registry No. 783355602); belinostat (NSC 726630; CAS Registry No. 414864009); chidamide (CAS Registry No. 743420022); entinostat (CAS Registry No. 209783802); givinostat (CAS Registry No. 732302997); mocetinostat (CAS Registry No. 726169739); panobinostat (CAS Registry No. 404950807); quisinostat (CAS Registry No. 875320299); resminostat (CAS Registry No. 864814880); romidepsin (CAS Registry No. 128517077); sulforaphane (CAS Registry No. 4478937); thioureidobutyronitrile (Kevetrin™; CAS Registry No. 6659890); valproic acid (NSC 93819; CAS Registry No. 99661); vorinostat (NSC 701852; CAS Registry No. 149647789); ACY-1215 (rocilinostat; CAS Registry No. 1316214524); CUDC-101 (CAS Registry No. 1012054599); CHR-2845 (tefinostat; CAS Registry No. 914382608); CHR-3996 (CAS Registry No. 1235859138); 4SC-202 (CAS Registry No. 910462430); CG200745 (CAS Registry No. 936221339); SB939 (pracinostat; CAS Registry No. 929016966).

Mitochondria Inhibitors: pancratistatin (NSC 349156; CAS Registry No. 96281311); rhodamine-123 (CAS Registry No. 63669709); edelfosine (NSC 324368; CAS Registry No. 70641519); d-alpha-tocopherol succinate (NSC 173849; CAS Registry No. 4345033); compound 11β (CAS Registry No. 865070377); aspirin (NSC 406186; CAS Registry No. 50782); ellipticine (CAS Registry No. 519233); berberine (CAS Registry No. 633658); cerulenin (CAS Registry No. 17397896); GX015-070 (Obatoclax®; 1H-Indole, 2-(2-(2-((3,5-dimethyl-1H-pyrrol-2-yl)methylene)-3-methoxy-2H-pyrrol-5-yl)-; NSC 729280; CAS Registry No. 803712676); celastrol (tripterine; CAS Registry No. 34157830); metformin (NSC 91485; CAS Registry No. 1115704); Brilliant green (NSC 5011; CAS Registry No. 633034); ME-344 (CAS Registry No. 1374524556).

Antimitotic Agents: allocolchicine (NSC 406042); auristatins, such as MMAE (monomethyl auristatin E; CAS Registry No. 474645-27-7) and MMAF (monomethyl auristatin F; CAS Registry No. 745017-94-1; halichondrin B (NSC 609395); colchicine (NSC 757; CAS Registry No. 64868); cholchicine derivative (N-benzoyl-deacetyl benzamide; NSC 33410; CAS Registry No. 63989753); dolastatin 10 (NSC 376128; CAS Registry No 110417-88-4); maytansine (NSC 153858; CAS Registry No. 35846-53-8); rhozoxin (NSC 332598; CAS Registry No. 90996546); taxol (NSC 125973; CAS Registry No. 33069624); taxol derivative ((2'-N-[3-(dimethylamino)propyl]glutaramate taxol; NSC 608832); thiocolchicine (3-demethylthiocolchicine; NSC 361792); trityl cysteine (NSC 49842; CAS Registry No. 2799077); vinblastine sulfate (NSC 49842; CAS Registry No. 143679); vincristine sulfate (NSC 67574; CAS Registry No. 2068782).

Any of these agents that include or that can be modified to include a site of attachment to a MBM can be included in the ADCs disclosed herein.

In some embodiments, the cytotoxic and/or cytostatic agent is an antimitotic agent.

In some embodiments, the cytotoxic and/or cytostatic agent is an auristatin, for example, monomethyl auristatin E ("MMAE:) or monomethyl auristatin F ("MMAF").

7.10.2. ADC Linkers

In the ADCs of the disclosure, the cytotoxic and/or cytostatic agents are linked to the MBM by way of ADC linkers. The ADC linker linking a cytotoxic and/or cytostatic agent to the MBM of an ADC can be short, long, hydrophobic, hydrophilic, flexible or rigid, or can be composed of segments that each independently have one or more of the above-mentioned properties such that the linker can include segments having different properties. The linkers can be polyvalent such that they covalently link more than one agent to a single site on the MBM, or monovalent such that covalently they link a single agent to a single site on the MBM.

As will be appreciated by a skilled artisan, the ADC linkers link cytotoxic and/or cytostatic agents to the MBM by forming a covalent linkage to the cytotoxic and/or cytostatic agent at one location and a covalent linkage to the MBM at another. The covalent linkages are formed by reaction between functional groups on the ADC linker and functional groups on the agents and MBM. As used herein, the expression "ADC linker" is intended to include (i) unconjugated forms of the ADC linker that include a functional group capable of covalently linking the ADC linker to a cytotoxic and/or cytostatic agent and a functional group capable of covalently linking the ADC linker to a MBM; (ii) partially conjugated forms of the ADC linker that include a functional group capable of covalently linking the ADC linker to a MBM and that is covalently linked to a cytotoxic and/or cytostatic agent, or vice versa; and (iii) fully conjugated forms of the ADC linker that are covalently linked to both a cytotoxic and/or cytostatic agent and a MBM. In some embodiments of ADC linkers and ADCs of the disclosure, as well as synthons used to conjugate linker-agents to MBMs, moieties comprising the functional groups on the ADC linker and covalent linkages formed between the ADC linker and MBM are specifically illustrated as $R_x$ and XY, respectively.

The ADC linkers are, but need not be, chemically stable to conditions outside the cell, and can be designed to cleave, immolate and/or otherwise specifically degrade inside the cell. Alternatively, ADC linkers that are not designed to specifically cleave or degrade inside the cell can be used. Choice of stable versus unstable ADC linker can depend upon the toxicity of the cytotoxic and/or cytostatic agent. For agents that are toxic to normal cells, stable linkers can be used. Agents that are selective or targeted and have lower toxicity to normal cells can be utilized, as chemical stability of the ADC linker to the extracellular milieu is less important. A wide variety of ADC linkers useful for linking drugs to MBMs in the context of ADCs are known. Any of these ADC linkers, as well as other ADC linkers, can be used to link the cytotoxic and/or cytostatic agents to the MBM of the ADCs of the disclosure.

Exemplary polyvalent ADC linkers that can be used to link many cytotoxic and/or cytostatic agents to a single MBM molecule are described, for example, in WO 2009/073445; WO 2010/068795; WO 2010/138719; WO 2011/120053; WO 2011/171020; WO 2013/096901; WO 2014/008375; WO 2014/093379; WO 2014/093394; WO 2014/093640. For example, the Fleximer linker technology developed by Mersana et al. has the potential to enable high-DAR ADCs with good physicochemical properties. As shown below, the Mersana technology is based on incorporating drug molecules into a solubilizing poly-acetal backbone via a sequence of ester bonds. The methodology renders highly-loaded ADCs (DAR up to 20) while maintaining good physicochemical properties.

Additional examples of dendritic type linkers can be found in US 2006/116422; US 2005/271615; de Groot et al., 2003, Angew. Chem. Int. Ed. 42:4490-4494; Amir et al., 2003, Angew. Chem. Int. Ed. 42:4494-4499; Shamis et al., 2004, J. Am. Chem. Soc. 126:1726-1731; Sun et al., 2002, Bioorganic & Medicinal Chemistry Letters 12:2213-2215; Sun et al., 2003, Bioorganic & Medicinal Chemistry 11:1761-1768; King et al., 2002, Tetrahedron Letters 43:1987-1990.

Exemplary monovalent ADC linkers that can be used are described, for example, in Nolting, 2013, Antibody-Drug Conjugates, Methods in Molecular Biology 1045:71-100; Kitson et al., 2013, CROs—MOs—Chemica—ggi—Chemistry Today 31(4):30-38; Ducry et al., 2010, Bioconjugate Chem. 21:5-13; Zhao et al., 2011, J. Med. Chem. 54:3606-3623; U.S. Pat. Nos. 7,223,837; 8,568,728; 8,535,678; and WO2004010957.

By way of example and not limitation, some cleavable and noncleavable ADC linkers that can be included in the ADCs are described below.

7.10.2.1. Cleavable ADC Linkers

In certain embodiments, the ADC linker selected is cleavable in vivo. Cleavable ADC linkers can include chemically or enzymatically unstable or degradable linkages. Cleavable ADC linkers generally rely on processes inside the cell to liberate the drug, such as reduction in the cytoplasm, exposure to acidic conditions in the lysosome, or cleavage by specific proteases or other enzymes within the cell. Cleavable ADC linkers generally incorporate one or more chemical bonds that are either chemically or enzymatically cleavable while the remainder of the ADC linker is noncleavable. In certain embodiments, an ADC linker comprises a chemically labile group such as hydrazone and/or disulfide groups. Linkers comprising chemically labile groups exploit differential properties between the plasma and some cytoplasmic compartments. The intracellular conditions to facilitate drug release for hydrazone containing ADC linkers are the acidic environment of endosomes and lysosomes, while the disulfide containing ADC linkers are reduced in the cytosol, which contains high thiol concentrations, e.g., glutathione. In certain embodiments, the plasma stability of an ADC linker comprising a chemically labile group can be increased by introducing steric hindrance using substituents near the chemically labile group.

Acid-labile groups, such as hydrazone, remain intact during systemic circulation in the blood's neutral pH environment (pH 7.3-7.5) and undergo hydrolysis and release the drug once the ADC is internalized into mildly acidic endosomal (pH 5.0-6.5) and lysosomal (pH 4.5-5.0) compartments of the cell. This pH dependent release mechanism has been associated with nonspecific release of the drug. To increase the stability of the hydrazone group of the ADC linker, the ADC linker can be varied by chemical modification, e.g., substitution, allowing tuning to achieve more efficient release in the lysosome with a minimized loss in circulation.

Hydrazone-containing ADC linkers can contain additional cleavage sites, such as additional acid-labile cleavage sites and/or enzymatically labile cleavage sites. ADCs including exemplary hydrazone-containing ADC linkers include the following structures:

(Ig)

339

-continued (Ih)

(Ii)

where D and Ab represent the cytotoxic and/or cytostatic agent (drug) and Ab, respectively, and n represents the number of drug-ADC linkers linked to the MBM. In certain ADC linkers such as linker (Ig), the ADC linker comprises two cleavable groups—a disulfide and a hydrazone moiety. For such ADC linkers, effective release of the unmodified free drug requires acidic pH or disulfide reduction and acidic pH. Linkers such as (Ih) and (Ii) have been shown to be effective with a single hydrazone cleavage site.

Additional ADC linkers which remain intact during systemic circulation and undergo hydrolysis and release the drug when the ADC is internalized into acidic cellular compartments include carbonates. Such ADC linkers can be useful in cases where the cytotoxic and/or cytostatic agent can be covalently attached through an oxygen.

Other acid-labile groups that can be included in ADC linkers include cis-aconityl-containing ADC linkers. cis-Aconityl chemistry uses a carboxylic acid juxtaposed to an amide bond to accelerate amide hydrolysis under acidic conditions.

Cleavable ADC linkers can also include a disulfide group. Disulfides are thermodynamically stable at physiological pH and are designed to release the drug upon internalization inside cells, where the cytosol provides a significantly more reducing environment compared to the extracellular environment. Scission of disulfide bonds generally requires the presence of a cytoplasmic thiol cofactor, such as (reduced) glutathione (GSH), such that disulfide-containing ADC linkers are reasonably stable in circulation, selectively releasing the drug in the cytosol. The intracellular enzyme protein disulfide isomerase, or similar enzymes capable of cleaving disulfide bonds, can also contribute to the preferential cleavage of disulfide bonds inside cells. GSH is reported to be present in cells in the concentration range of 0.5-10 mM compared with a significantly lower concentration of GSH or cysteine, the most abundant low-molecular weight thiol, in circulation at approximately 5 Tumor cells, where irregular blood flow leads to a hypoxic state, result in enhanced activity of reductive enzymes and therefore even higher glutathione concentrations. In certain embodiments, the in vivo stability of a disulfide-containing ADC linker can be enhanced by chemical modification of the ADC linker, e.g., use of steric hindrance adjacent to the disulfide bond.

ADCs including exemplary disulfide-containing ADC linkers include the following structures:

(Ij)

(Ik)

(Il)

where D and Ab represent the drug and MBM, respectively, n represents the number of drug-ADC linkers linked to the MBM and R is independently selected at each occurrence from hydrogen or alkyl, for example. In certain embodiments, increasing steric hindrance adjacent to the disulfide bond increases the stability of the ADC linker. Structures such as (Ij) and (Il) show increased in vivo stability when one or more R groups is selected from a lower alkyl such as methyl.

Another type of cleavable ADC linker that can be used is an ADC linker that is specifically cleaved by an enzyme. Such ADC linkers are typically peptide-based or include peptidic regions that act as substrates for enzymes. Peptide based ADC linkers tend to be more stable in plasma and extracellular milieu than chemically labile ADC linkers. Peptide bonds generally have good serum stability, as lysosomal proteolytic enzymes have very low activity in blood due to endogenous inhibitors and the unfavorably high pH value of blood compared to lysosomes. Release of a drug from a MBM occurs specifically due to the action of lysosomal proteases, e.g., cathepsin and plasmin. These proteases can be present at elevated levels in certain tumor cells.

In exemplary embodiments, the cleavable peptide is selected from tetrapeptides such as Gly-Phe-Leu-Gly, (SEQ ID NO: 553), Ala-Leu-Ala-Leu (SEQ ID NO: 554) or dipeptides such as Val-Cit, Val-Ala, Met-(D)Lys, Asn-(D) Lys, Val-(D)Asp, Phe-Lys, Ile-Val, Asp-Val, His-Val, Nor-Val-(D)Asp, Ala-(D)Asp 5, Met-Lys, Asn-Lys, Ile-Pro, Me3Lys-Pro, PhenylGly-(D)Lys, Met-(D)Lys, Asn-(D)Lys, Pro-(D)Lys, Met-(D)Lys, Asn-(D)Lys, AM Met-(D)Lys, Asn-(D)Lys, AW Met-(D)Lys, and Asn-(D)Lys. In certain embodiments, dipeptides can be selected over longer polypeptides due to hydrophobicity of the longer peptides.

A variety of dipeptide-based cleavable ADC linkers useful for linking drugs such as doxorubicin, mitomycin, camptothecin, pyrrolobenzodiazepine, tallysomycin and auristatin/auristatin family members to MBMs have been described (see, Dubowchik et al., 1998, J. Org. Chem. 67:1866-1872; Dubowchik et al., 1998, Bioorg. Med. Chem. Lett. 8(21): 3341-3346; Walker et al., 2002, Bioorg. Med. Chem. Lett. 12:217-219; Walker et al., 2004, Bioorg. Med. Chem. Lett. 14:4323-4327; Sutherland et al., 2013, Blood 122: 1455-1463; and Francisco et al., 2003, Blood 102:1458-1465). All of these dipeptide ADC linkers, or modified versions of these dipeptide ADC linkers, can be used in the ADCs of the disclosure. Other dipeptide ADC linkers that can be used include those found in ADCs such as Seattle Genetics' Brentuximab Vendotin SGN-35 (Adcetris™), Seattle Genetics SGN-75 (anti-CD-70, Val-Cit-monomethyl auristatin F(MMAF), Seattle Genetics SGN-CD33A (anti-CD-33, Val-Ala-(SGD-1882)), Celldex Therapeutics glembatumumab (CDX-011) (anti-NMB, Val-Cit-monomethyl auristatin E (MMAE), and Cytogen PSMA-ADC (PSMA-ADC-1301) (anti-PSMA, Val-Cit-MMAE).

Enzymatically cleavable ADC linkers can include a self-immolative spacer to spatially separate the drug from the site of enzymatic cleavage. The direct attachment of a drug to a peptide ADC linker can result in proteolytic release of an amino acid adduct of the drug, thereby impairing its activity. The use of a self-immolative spacer allows for the elimination of the fully active, chemically unmodified drug upon amide bond hydrolysis.

One self-immolative spacer is the bifunctional para-aminobenzyl alcohol group, which is linked to the peptide through the amino group, forming an amide bond, while amine containing drugs can be attached through carbamate functionalities to the benzylic hydroxyl group of the ADC linker (PABC). The resulting prodrugs are activated upon protease-mediated cleavage, leading to a 1,6-elimination reaction releasing the unmodified drug, carbon dioxide, and remnants of the ADC linker group. The following scheme depicts the fragmentation of p-amidobenzyl ether and release of the drug:

where X-D represents the unmodified drug.

Heterocyclic variants of this self-immolative group have also been described. See for example, U.S. Pat. No. 7,989,434.

In some embodiments, the enzymatically cleavable ADC linker is a β-glucuronic acid-based ADC linker. Facile release of the drug can be realized through cleavage of the β-glucuronide glycosidic bond by the lysosomal enzyme β-glucuronidase. This enzyme is present abundantly within lysosomes and is overexpressed in some tumor types, while the enzyme activity outside cells is low. β-Glucuronic acid-based ADC linkers can be used to circumvent the tendency of an ADC to undergo aggregation due to the hydrophilic nature of β-glucuronides. In some embodiments, β-glucuronic acid-based ADC linkers can be used as ADC linkers for ADCs linked to hydrophobic drugs. The following scheme depicts the release of the drug from and ADC containing a β-glucuronic acid-based ADC linker:

A variety of cleavable β-glucuronic acid-based ADC linkers useful for linking drugs such as auristatins, camptothecin and doxorubicin analogues, CBI minor-groove binders, and psymberin to MBMs have been described (see, Nolting, Chapter 5 "Linker Technology in Antibody-Drug Conjugates," In: Antibody-Drug Conjugates: Methods in Molecular Biology, vol. 1045, pp. 71-100, Laurent Ducry (Ed.), Springer Science & Business Medica, LLC, 2013; Jeffrey et al., 2006, Bioconjug. Chem. 17:831-840; Jeffrey et al., 2007, Bioorg. Med. Chem. Lett. 17:2278-2280; and Jiang et al., 2005, J. Am. Chem. Soc. 127:11254-11255). All of these β-glucuronic acid-based ADC linkers can be used in the ADCs of the disclosure.

Additionally, cytotoxic and/or cytostatic agents containing a phenol group can be covalently bonded to an ADC linker through the phenolic oxygen. One such ADC linker, described in WO 2007/089149, relies on a methodology in which a diamino-ethane "SpaceLink" is used in conjunction with traditional "PABO"-based self-immolative groups to deliver phenols. The cleavage of the ADC linker is depicted schematically below, where D represents a cytotoxic and/or cytostatic agent having a phenolic hydroxyl group.

representative linker with PABO unit

"SpaceLink"

lysosomal enzyme to mAB

HO—D

SpaceLink's ultimate fate is cyclic urea a formate and an alcohol; and oligonucleotide linkages formed by a phosphoramidite group, including but not limited to, at the end of a polymer, and a 5' hydroxyl group of an oligonucleotide.

In certain embodiments, the ADC linker comprises an enzymatically cleavable peptide moiety, for example, an ADC linker comprising structural formula (IVa) or (IVb):

(IVa)

(IVb)

or a salt thereof, where: peptide represents a peptide (illustrated C→N and not showing the carboxy and amino "termini") cleavable by a lysosomal enzyme; T represents a polymer comprising one or more ethylene glycol units or an alkylene chain, or combinations thereof; $R^a$ is selected from hydrogen, alkyl, sulfonate and methyl sulfonate; p is an integer ranging from 0 to 5; q is 0 or 1; x is 0 or 1; / is 0 or 1; / represents the point of attachment of the ADC linker to a cytotoxic and/or cytostatic agent; and / represents the point of attachment to the remainder of the ADC linker.

In certain embodiments, the peptide is selected from a tripeptide or a dipeptide. In particular embodiments, the dipeptide is selected from: Val-Cit; Cit-Val; Ala-Ala; Ala-Cit; Cit-Ala; Asn-Cit; Cit-Asn; Cit-Cit; Val-Glu; Glu-Val; Ser-Cit; Cit-Ser; Lys-Cit; Cit-Lys; Asp-Cit; Cit-Asp; Ala-Val; Val-Ala; Phe-Lys; Val-Lys; Ala-Lys; Phe-Cit; Leu-Cit; Ile-Cit; Phe-Arg; and Trp-Cit. In certain embodiments, the dipeptide is selected from: Cit-Val; and Ala-Val.

Specific exemplary embodiments of ADC linkers according to structural formula (IVa) that can be included in the ADCs include the ADC linkers illustrated below (as illustrated, the ADC linkers include a group suitable for covalently linking the ADC linker to a MBM):

Cleavable ADC linkers can include noncleavable portions or segments, and/or cleavable segments or portions can be included in an otherwise non-cleavable ADC linker to render it cleavable. By way of example only, polyethylene glycol (PEG) and related polymers can include cleavable groups in the polymer backbone. For example, a polyethylene glycol or polymer ADC linker can include one or more cleavable groups such as a disulfide, a hydrazone or a dipeptide.

Other degradable linkages that can be included in ADC linkers include ester linkages formed by the reaction of PEG carboxylic acids or activated PEG carboxylic acids with alcohol groups on a biologically active agent, where such ester groups generally hydrolyze under physiological conditions to release the biologically active agent. Hydrolytically degradable linkages include, but are not limited to, carbonate linkages; imine linkages resulting from reaction of an amine and an aldehyde; phosphate ester linkages formed by reacting an alcohol with a phosphate group; acetal linkages that are the reaction product of an aldehyde and an alcohol; orthoester linkages that are the reaction product of (IVa.1)

-continued (IVa.2)

(IVa.3)

(IVa.4)

(IVa.5)

(IVa.6)

(IVa.7)

Specific exemplary embodiments of ADC linkers according to structural formula (IVb) that can be included in the ADCs include the ADC linkers illustrated below (as illustrated, the ADC linkers include a group suitable for covalently linking the ADC linker to a MBM):

(IVb.1)

(IVb.2)

(IVb.3)

(IVb.4)

(IVb.5)

-continued (IVb.7)

(IVb.8)

(IVb.9)

(IVb.10)

-continued (IVb.11)

(IVb.12)

(IVb.13)

(IVb.14)

(IVb.15)

-continued (IVb.16)

(IVb.17)

(IVb.18)

(IVb.19)

In certain embodiments, the ADC linker comprises an enzymatically cleavable peptide moiety, for example, an ADC linker comprising structural formula (IVc) or (IVd):

(IVc)

-continued (IVd)

or a salt thereof, where: peptide represents a peptide (illustrated C→N and not showing the carboxy and amino "termini") cleavable by a lysosomal enzyme; T represents a polymer comprising one or more ethylene glycol units or an alkylene chain, or combinations thereof; $R^a$ s selected from hydrogen, alkyl, sulfonate and methyl sulfonate; p is an integer ranging from 0 to 5; q is 0 or 1; x is 0 or 1; $_nx$ ⌇ is 0 or 1; $_nx$ ⌇ represents the point of attachment of the ADC linker to a cytotoxic and/or cytostatic agent; and ⌇ represents the point of attachment to the remainder of the ADC linker.

Specific exemplary embodiments of ADC linkers according to structural formula (IVc) that can be included in the ADCs include the ADC linkers illustrated below (as illustrated, the ADC linkers include a group suitable for covalently linking the ADC linker to a MBM):

(IVc.1)

(IVc.2)

(IVc.3)

(IVc.4)

(IVc.5)

(IVc.6)

(IVc.7)

357

Specific exemplary embodiments of ADC linkers according to structural formula (IVd) that can be included in the ADCs include the ADC linkers illustrated below (as illustrated, the ADC linkers include a group suitable for covalently linking the ADC linker to a MBM):

(IVd.1)

(IVd.2)

(IVd.3)

(IVd.4)

(IVd.5)

358

-continued (IVd.6)

(IVd.7)

(IVd.8)

(IVd.9)

(IVd.10)

-continued (IVd.11)

(IVd.12)

(IVd.13)

(IVd.14)

-continued (IVd.15)

(IVd.16)

(IVd.17)

In certain embodiments, the ADC linker comprising structural formula (IVa), (IVb), (IVc), or (IVd) further comprises a carbonate moiety cleavable by exposure to an acidic medium. In particular embodiments, the ADC linker is attached through an oxygen to a cytotoxic and/or cytostatic agent.

7.10.2.2. Non-Cleavable Linkers

Although cleavable ADC linkers can provide certain advantages, the ADC linkers comprising the ADCs need not be cleavable. For noncleavable ADC linkers, the release of drug does not depend on the differential properties between the plasma and some cytoplasmic compartments. The release of the drug is postulated to occur after internalization of the ADC via antigen-mediated endocytosis and delivery to lysosomal compartment, where the MBM is degraded to the level of amino acids through intracellular proteolytic degradation. This process releases a drug derivative, which is formed by the drug, the ADC linker, and the amino acid residue to which the ADC linker was covalently attached. The amino acid drug metabolites from conjugates with noncleavable ADC linkers are more hydrophilic and generally less membrane permeable, which leads to less bystander effects and less nonspecific toxicities compared to conjugates with a cleavable ADC linker. In general, ADCs with noncleavable ADC linkers have greater stability in circulation than ADCs with cleavable ADC linkers. Non-cleavable ADC linkers can be alkylene chains, or can be polymeric in nature, such as, for example, based upon polyalkylene glycol polymers, amide polymers, or can include segments of alkylene chains, polyalkylene glocols and/or amide polymers.

A variety of non-cleavable ADC linkers used to link drugs to MBMs have been described. See, Jeffrey et al., 2006, Bioconjug. Chem. 17; 831-840; Jeffrey et al., 2007, Bioorg. Med. Chem. Lett. 17:2278-2280; and Jiang et al., 2005, J. Am. Chem. Soc. 127:11254-11255. All of these ADC linkers can be included in the ADCs of the disclosure.

In certain embodiments, the ADC linker is non-cleavable in vivo, for example an ADC linker according to structural formula (VIa), (VIb), (VIc) or (VId) (as illustrated, the ADC linkers include a group suitable for covalently linking the ADC linker to a MBM:

(VIa)

(VIb)

-continued (VIc)

(VId)

or salts thereof, where: $R^a$ is selected from hydrogen, alkyl, sulfonate and methyl sulfonate; $R^x$ is a moiety including a functional group capable of covalently linking the ADC linker to a MBM; and $\nwarrow$ represents the point of attachment of the ADC linker to a cytotoxic and/or cytostatic agent.

Specific exemplary embodiments of ADC linkers according to structural formula (VIa)-(VId) that can be included in the ADCs include the ADC linkers illustrated below (as illustrated, the ADC linkers include a group suitable for covalently linking the ADC linker to a MBM, and $\nwarrow$ represents the point of attachment to a cytotoxic and/or cytostatic agent):

(VIa)

(VIa.1)

(VIc.1)

(VIc.2)

(VId.1)

(VId.2)

(VId.3)

7.10.2.3. Groups Used to Attach Linkers to MBMs

A variety of groups can be used to attach ADC linker-drug synthons to MBMs (e.g., TBMs) to yield ADCs. Attachment groups can be electrophilic in nature and include: maleimide groups, activated disulfides, active esters such as NHS esters and HOBt esters, haloformates, acid halides, alkyl and benzyl halides such as haloacetamides. As discussed below, there are also emerging technologies related to "self-stabilizing" maleimides and "bridging disulfides" that can be used in accordance with the disclosure. The specific group used will depend, in part, on the site of attachment to the MBM.

One example of a "self-stabilizing" maleimide group that hydrolyzes spontaneously under MBM conjugation conditions to give an ADC species with improved stability is depicted in the schematic below. See US20130309256 A1; also Lyon et al., Nature Biotech published online, doi: 10.1038/nbt.2968.

Normal System:

Leads to "DAR loss" over time

365

SGN MalDPR (Maleimido Dipropylamino) System:

US20130309256A1

366

-continued stable in plasma
(retro hetero-Michael
reaction shown above slow)

Polytherics has disclosed a method for bridging a pair of sulfhydryl groups derived from reduction of a native hinge disulfide bond. See, Badescu et al., 2014, Bioconjugate Chem. 25:1124-1136. The reaction is depicted in the schematic below. An advantage of this methodology is the ability to synthesize enriched DAR4 ADCs by full reduction of IgGs (to give 4 pairs of sulfhydryls) followed by reaction with 4 equivalents of the alkylating agent. ADCs containing "bridged disulfides" have increased stability.

-continued

"bridged disulfide"

Similarly, as depicted below, a maleimide derivative (1, below) that is capable of bridging a pair of sulfhydryl groups has been developed. See WO2013/085925.

7.10.2.4. ADC Linker Selection Considerations

As is known by skilled artisans, the ADC linker selected for a particular ADC can be influenced by a variety of factors, including but not limited to, the site of attachment to the MBM (e.g., lys, cys or other amino acid residues), structural constraints of the drug pharmacophore and the lipophilicity of the drug. The specific ADC linker selected for an ADC should seek to balance these different factors for the specific MBM/drug combination. For a review of the factors that are influenced by choice of ADC linkers in ADCs, see Nolting, Chapter 5 "Linker Technology in Antibody-Drug Conjugates," In: Antibody-Drug Conjugates: Methods in Molecular Biology, vol. 1045, pp. 71-100, Laurent Ducry (Ed.), Springer Science & Business Medica, LLC, 2013.

For example, ADCs have been observed to effect killing of bystander antigen-negative cells present in the vicinity of the antigen-positive tumor cells. The mechanism of bystander cell killing by ADCs has indicated that metabolic products formed during intracellular processing of the ADCs may play a role. Neutral cytotoxic metabolites generated by metabolism of the ADCs in antigen-positive cells appear to play a role in bystander cell killing while charged metabolites can be prevented from diffusing across the membrane into the medium and therefore cannot affect bystander killing. In certain embodiments, the ADC linker is selected to attenuate the bystander killing effect caused by cellular metabolites of the ADC. In certain embodiments, the ADC linker is selected to increase the bystander killing effect.

The properties of the ADC linker can also impact aggregation of the ADC under conditions of use and/or storage. Typically, ADCs reported in the literature contain no more than 3-4 drug molecules per antibody molecule (see, e.g., Chari, 2008, Acc Chem Res 41:98-107). Attempts to obtain higher drug-to-antibody ratios ("DAR") often failed, particularly if both the drug and the ADC linker were hydrophobic, due to aggregation of the ADC (King et al., 2002, J Med Chem 45:4336-4343; Hollander et al., 2008, Bioconjugate Chem 19:358-361; Burke et al., 2009 Bioconjugate Chem 20:1242-1250). In many instances, DARs higher than 3-4 could be beneficial as a means of increasing potency. In instances where the cytotoxic and/or cytostatic agent is hydrophobic in nature, it can be desirable to select ADC linkers that are relatively hydrophilic as a means of reducing ADC aggregation, especially in instances where DARS greater than 3-4 are desired. Thus, in certain embodiments, the ADC linker incorporates chemical moieties that reduce aggregation of the ADCs during storage and/or use. An ADC linker can incorporate polar or hydrophilic groups such as charged groups or groups that become charged under physiological pH to reduce the aggregation of the ADCs. For example, an ADC linker can incorporate charged groups such as salts or groups that deprotonate, e.g., carboxylates, or protonate, e.g., amines, at physiological pH.

Exemplary polyvalent ADC linkers that have been reported to yield DARs as high as 20 that can be used to link numerous cytotoxic and/or cytostatic agents to a MBM are described in WO 2009/073445; WO 2010/068795; WO 2010/138719; WO 2011/120053; WO 2011/171020; WO 2013/096901; WO 2014/008375; WO 2014/093379; WO 2014/093394; WO 2014/093640.

In particular embodiments, the aggregation of the ADCs during storage or use is less than about 10% as determined by size-exclusion chromatography (SEC). In particular embodiments, the aggregation of the ADCs during storage or use is less than 10%, such as less than about 5%, less than about 4%, less than about 3%, less than about 2%, less than about 1%, less than about 0.5%, less than about 0.1%, or even lower, as determined by size-exclusion chromatography (SEC).

7.10.3. Methods of Making ADCs

The ADCs can be synthesized using chemistries that are well-known. The chemistries selected will depend upon, among other things, the identity of the cytotoxic and/or cytostatic agent(s), the ADC linker and the groups used to attach ADC linker to the MBM. Generally, ADCs according to formula (I) can be prepared according to the following scheme:

$$D\text{-}L\text{-}R^x + Ab\text{-}R^y \rightarrow [D\text{-}L\text{-}XY]_n\text{-}Ab \qquad (I)$$

where D, L, Ab, XY and n are as previously defined, and $R^x$ and $R^y$ represent complementary groups capable of forming a covalent linkages with one another, as discussed above.

The identities of groups $R^x$ and $R^y$ will depend upon the chemistry used to link synthon D-L-$R^x$ to the MBM. Generally, the chemistry used should not alter the integrity of the MBM, for example its ability to bind its target. In some cases, the binding properties of the conjugated antibody will closely resemble those of the unconjugated MBM. A variety of chemistries and techniques for conjugating molecules to biological molecules and in particular to immunoglobulins, whose components are typically building blocks of the MBMs of the disclosure, are well-known. See, e.g., Amon et al., "Monoclonal Antibodies For Immunotargeting Of Drugs In Cancer Therapy," in: Monoclonal Antibodies And Cancer Therapy, Reisfeld et al. Eds., Alan R. Liss, Inc., 1985; Hellstrom et al., "Antibodies For Drug Delivery," in: Controlled Drug Delivery, Robinson et al. Eds., Marcel Dekker, Inc., 2nd Ed. 1987; Thorpe, "Antibody Carriers Of Cytotoxic Agents In Cancer Therapy: A Review," in: Monoclonal Antibodies '84: Biological And Clinical Applications, Pinchera et al., Eds., 1985; "Analysis, Results, and Future Prospective of the Therapeutic Use of Radiolabeled Antibody In Cancer Therapy," in: Monoclonal Antibodies For Cancer Detection And Therapy, Baldwin et al., Eds., Academic Press, 1985; Thorpe et al., 1982, Immunol. Rev. 62:119-58; PCT publication WO 89/12624. Any of these chemistries can be used to link the synthons to a MBM.

A number of functional groups $R^x$ and chemistries useful for linking synthons to accessible lysine residues are known, and include by way of example and not limitation NHS-esters and isothiocyanates.

A number of functional groups $R^x$ and chemistries useful for linking synthons to accessible free sulfhydryl groups of cysteine residues are known, and include by way of example and not limitation haloacetyls and maleimides.

However, conjugation chemistries are not limited to available side chain groups. Side chains such as amines can be converted to other useful groups, such as hydroxyls, by linking an appropriate small molecule to the amine. This strategy can be used to increase the number of available linking sites on the antibody by conjugating multifunctional small molecules to side chains of accessible amino acid residues of the MBM. Functional groups $R^x$ suitable for covalently linking the synthons to these "converted" functional groups are then included in the synthons.

The MBM can also be engineered to include amino acid residues for conjugation. An approach for engineering MBMs to include non-genetically encoded amino acid residues useful for conjugating drugs in the context of ADCs is described by Axup et al., 2012, Proc Natl Acad Sci USA. 109(40):16101-16106, as are chemistries and functional group useful for linking synthons to the non-encoded amino acids.

Typically, the synthons are linked to the side chains of amino acid residues of the MBM, including, for example, the primary amino group of accessible lysine residues or the sulfhydryl group of accessible cysteine residues. Free sulfhydryl groups can be obtained by reducing interchain disulfide bonds.

For linkages where $R^y$ is a sulfhydryl group (for example, when $R^x$ is a maleimide), the MBM is generally first fully or partially reduced to disrupt interchain disulfide bridges between cysteine residues.

Cysteine residues that do not participate in disulfide bridges can be engineered into a MBM by modification of one or more codons. Reducing these unpaired cysteines yields a sulfhydryl group suitable for conjugation. In some embodiments, MBMs are engineered to introduce one or more cysteine residues as sites for conjugation to a drug moiety (see, Junutula, et al, 2008, Nat Biotechnol, 26:925-932).

Sites for cysteine substitution can be selected in a constant region to provide stable and homogeneous conjugates. A MBM can have, for example, two or more cysteine substitutions, and these substitutions can be used in combination with other modification and conjugation methods as described herein. Methods for inserting cysteine at specific locations of an antibody are known, see, e.g., Lyons et al., 1990, Protein Eng., 3:703-708, WO 2011/005481, WO2014/124316, WO 2015/138615. In certain embodiments, a MBM comprises a substitution of one or more amino acids with cysteine on a constant region selected from positions 117, 119, 121, 124, 139, 152, 153, 155, 157, 164, 169, 171, 174, 189, 205, 207, 246, 258, 269, 274, 286, 288, 290, 292, 293, 320, 322, 326, 333, 334, 335, 337, 344, 355, 360, 375, 382, 390, 392, 398, 400 and 422 of a heavy chain, where the positions are numbered according to the EU system. In some embodiments, a MBM comprises a substitution of one or more amino acids with cysteine on a constant region selected from positions 107, 108, 109, 114, 129, 142, 143, 145, 152, 154, 156, 159, 161, 165, 168, 169, 170, 182, 183, 197, 199, and 203 of a light chain, where the positions are numbered according to the EU system, and where the light chain is a human kappa light chain. In certain embodiments a MBM comprises a combination of substitution of two or more amino acids with cysteine on a constant region, where the combinations comprise substitutions at positions 375 of a heavy chain, position 152 of a heavy chain, position 360 of a heavy chain, or position 107 of a light chain and where the positions are numbered according to the EU system. In certain embodiments a MBM comprises a substitution of one amino acid with cysteine on a constant region where the substitution is position 375 of a heavy chain, position 152 of a heavy chain, position 360 of a heavy chain, position 107 of a light chain, position 165 of a light chain or position 159 of a light chain and where the positions are numbered according to the EU system, and where the light chain is a kappa chain.

In particular embodiments, a MBM comprises a combination of substitution of two amino acids with cysteine on a constant regions, where the MBM comprises cysteines at positions 152 and 375 of a heavy chain, where the positions are numbered according to the EU system.

In other particular embodiments, a MBM comprises a substitution of one amino acid with cysteine at position 360 of a heavy chain, where the positions are numbered according to the EU system.

In other particular embodiments, a MBM comprises a substitution of one amino acid with cysteine at position 107 of a light chain, where the positions are numbered according to the EU system, and where the light chain is a kappa chain.

Other positions for incorporating engineered cysteines can include, by way of example and not limitation, positions S112C, S113C, A114C, S115C, A176O, 5180C, S252C, V286C, V292C, S357C, A359C, S398C, S428C (Kabat numbering) on the human IgG₁ heavy chain and positions V110O, S114C, S121C, S127O, S168O, V205C (Kabat numbering) on the human Ig kappa light chain (see, e.g., U.S. Pat. Nos. 7,521,541, 7,855,275 and 8,455,622).

MBMs useful in ADCs disclosed herein can additionally or alternatively be modified to introduce one or more other reactive amino acids (other than cysteine), including Pcl, pyrrolysine, peptide tags (such as S6, A1 and ybbR tags), and non-natural amino acids, in place of at least one amino acid of the native sequence, thus providing a reactive site on the MBM for conjugation to a drug moiety. For example, MBMs can be modified to incorporate Pcl or pyrrolysine (W. Ou et al., 2011, PNAS, 108(26):10437-10442;

WO2014124258) or unnatural amino acids (Axup, et al., 2012, PNAS, 109:16101-16106; for review, see C. C. Liu and P. G. Schultz, 2010, Annu Rev Biochem 79:413-444; Kim, et al., 2013, Curr Opin Chem Biol. 17:412-419) as sites for conjugation to a drug. Similarly, peptide tags for enzymatic conjugation methods can be introduced into a MBM (see, Strop et al. 2013, Chem Biol. 20(2):161-7; Rabuka, 2010, Curr Opin Chem Biol. 14(6):790-6; Rabuka, et al., 2012, Nat Protoc. 7(6):1052-67). One other example is the use of 4'-phosphopantetheinyl transferases (PPTase) for the conjugation of Coenzyme A analogs (WO2013184514). Such modified or engineered MBMs can be conjugated with payloads or linker-payload combinations according to methods known.

As will appreciated by skilled artisans, the number of agents (e.g., cytotoxic and/or cytostatic agents) linked to a MBM molecule can vary, such that a collection of ADCs can be heterogeneous in nature, where some MBMs contain one linked agent, some two, some three, etc. (and some none). The degree of heterogeneity will depend upon, among other things, the chemistries used for linking the agents. For example, where the MBMs are reduced to yield sulfhydryl groups for attachment, heterogeneous mixtures of MBMs having zero, 2, 4, 6 or 8 linked agents per molecule are often produced. Furthermore, by limiting the molar ratio of attachment compound, MBMs having zero, 1, 2, 3, 4, 5, 6, 7 or 8 linked agents per molecule are often produced. Thus, it will be understood that depending upon context, stated drug MBM ratios (DTRs) can be averages for a collection of MBMs. For example, "DTR4" can refer to an ADC preparation that has not been subjected to purification to isolate specific DTR peaks and can comprise a heterogeneous mixture of ADC molecules having different numbers of cytostatic and/or cytotoxic agents attached per MBM (e.g., 0, 2, 4, 6, 8 agents per MBM), but has an average drug-to-MBM ratio of 4. Similarly, in some embodiments, "DTR2" refers to a heterogeneous ADC preparation in which the average drug-to-MBM ratio is 2.

When enriched preparations are desired, MBMs having defined numbers of linked agents (e.g., cytotoxic and/or cytostatic agents) can be obtained via purification of heterogeneous mixtures, for example, via column chromatography, e.g., hydrophobic interaction chromatography.

Purity can be assessed by a variety of known methods. As an example, an ADC preparation can be analyzed via HPLC or other chromatography and the purity assessed by analyzing areas under the curves of the resultant peaks.

7.11. Pharmaceutical Compositions

The MBMs (e.g., TBMs) (as well as their conjugates; references to MBMs in this disclosure also refers to conjugates comprising the MBMs, such as ADCs, unless the context dictates otherwise) can be formulated as pharmaceutical compositions comprising the MBMs, for example containing one or more pharmaceutically acceptable excipients or carriers. To prepare pharmaceutical or sterile compositions comprising the MBMs of the present disclosure a MBM preparation can be combined with one or more pharmaceutically acceptable excipient or carrier.

For example, formulations of MBMs can be prepared by mixing MBMs with physiologically acceptable carriers, excipients, or stabilizers in the form of, e.g., lyophilized powders, slurries, aqueous solutions, lotions, or suspensions (see, e.g., Hardman et al., 2001, Goodman and Gilman's The Pharmacological Basis of Therapeutics, McGraw-Hill, New York, N.Y.; Gennaro, 2000, Remington: The Science and Practice of Pharmacy, Lippincott, Williams, and Wilkins, New York, N.Y.; Avis, et al. (eds.), 1993, Pharmaceutical Dosage Forms: General Medications, Marcel Dekker, NY; Lieberman, et al. (eds.), 1990, Pharmaceutical Dosage Forms: Tablets, Marcel Dekker, NY; Lieberman, et al. (eds.), 1990, Pharmaceutical Dosage Forms: Disperse Systems, Marcel Dekker, NY; Weiner and Kotkoskie, 2000, Excipient Toxicity and Safety, Marcel Dekker, Inc., New York, N.Y.).

Selecting an administration regimen for a MBM depends on several factors, including the serum or tissue turnover rate of the MBM, the level of symptoms, the immunogenicity of the MBM, and the accessibility of the target cells. In certain embodiments, an administration regimen maximizes the amount of MBM delivered to the subject consistent with an acceptable level of side effects. Accordingly, the amount of MBM delivered depends in part on the particular MBM and the severity of the condition being treated. Guidance in selecting appropriate doses of antibodies and small molecules are available (see, e.g., Wawrzynczak, 1996, Antibody Therapy, Bios Scientific Pub. Ltd, Oxfordshire, UK; Kresina (ed.), 1991, Monoclonal Antibodies, Cytokines and Arthritis, Marcel Dekker, New York, N.Y.; Bach (ed.), 1993, Monoclonal Antibodies and Peptide Therapy in Autoimmune Diseases, Marcel Dekker, New York, N.Y.; Baert et al., 2003, New Engl. J. Med. 348:601-608; Milgrom et al., 1999, New Engl. J. Med. 341:1966-1973; Slamon et al., 2001, New Engl. J. Med. 344:783-792; Beniaminovitz et al., 2000, New Engl. J. Med. 342:613-619; Ghosh et al., 2003, New Engl. J. Med. 348:24-32; Lipsky et al., 2000, New Engl. J. Med. 343:1594-1602).

Determination of the appropriate dose is made by the clinician, e.g., using parameters or factors known or suspected in the art to affect treatment or predicted to affect treatment. Generally, the dose begins with an amount somewhat less than the optimum dose and it is increased by small increments thereafter until the desired or optimum effect is achieved relative to any negative side effects. Important diagnostic measures include those of symptoms of, e.g., the inflammation or level of inflammatory cytokines produced.

Actual dosage levels of the MBMs in the pharmaceutical compositions of the present disclosure can be varied so as to obtain an amount of the MBM which is effective to achieve the desired therapeutic response for a particular subject, composition, and mode of administration, without being toxic to the subject. The selected dosage level will depend upon a variety of pharmacokinetic factors including the activity of the particular MBM, the route of administration, the time of administration, the rate of excretion of the particular MBM being employed, the duration of the treatment, other agents (e.g., active agents such as therapeutic drugs or compounds and/or inert materials used as carriers) in combination with the particular MBM employed, the age, sex, weight, condition, general health and prior medical history of the subject being treated, and like factors known in the medical arts.

Compositions comprising the MBMs can be provided by continuous infusion, or by doses at intervals of, e.g., one day, one week, or 1-7 times per week. Doses can be provided intravenously, subcutaneously, topically, orally, nasally, rectally, intramuscular, intracerebrally, or by inhalation. An exemplary dose protocol is one involving the maximal dose or dose frequency that avoids significant undesirable side effects.

An effective amount for a particular subject can vary depending on factors such as the condition being treated, the overall health of the subject, the method route and dose of administration and the severity of side effects (see, e.g., Maynard, et al. (1996) A Handbook of SOPs for Good Clinical Practice, Interpharm Press, Boca Raton, Fla.; Dent (2001) Good Laboratory and Good Clinical Practice, Urch Publ., London, UK).

The route of administration can be by, e.g., topical or cutaneous application, injection or infusion by intravenous, intraperitoneal, intracerebral, intramuscular, intraocular, intraarterial, intracerebrospinal, intralesional, or by sustained release systems or an implant (see, e.g., Sidman et al., 1983, Biopolymers 22:547-556; Langer et al., 1981, J. Biomed. Mater. Res. 15:167-277; Langer, 1982, Chem. Tech. 12:98-105; Epstein et al., 1985, Proc. Natl. Acad. Sci. USA 82:3688-3692; Hwang et al., 1980, Proc. Natl. Acad. Sci. USA 77:4030-4034; U.S. Pat. Nos. 6,350,466 and 6,316,024). Where necessary, the composition can also include a solubilizing agent and a local anesthetic such as lidocaine to ease pain at the site of the injection. In addition, pulmonary administration can also be employed, e.g., by use of an inhaler or nebulizer, and formulation with an aerosolizing agent. See, e.g., U.S. Pat. Nos. 6,019,968, 5,985, 320, 5,985,309, 5,934,272, 5,874,064, 5,855,913, 5,290,540, and 4,880,078; and PCT Publication Nos. WO 92/19244, WO 97/32572, WO 97/44013, WO 98/31346, and WO 99/66903.

A composition of the present disclosure can also be administered via one or more routes of administration using one or more of a variety of known methods. As will be appreciated by a skilled artisan, the route and/or mode of administration will vary depending upon the desired results. Selected routes of administration for MBMs include intravenous, intramuscular, intradermal, intraperitoneal, subcutaneous, spinal or other general routes of administration, for example by injection or infusion. General administration can represent modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, a composition of the disclosure can be administered via a non-general route, such as a topical, epidermal or mucosal route of administration, for example, intranasally, orally, vaginally, rectally, sublingually or topically. In one embodiment, the MBMs is administered by infusion. In another embodiment, an MBM is administered subcutaneously.

If the MBMs are administered in a controlled release or sustained release system, a pump can be used to achieve controlled or sustained release (see Langer, supra; Sefton, 1987, CRC Crit. Ref Biomed. Eng. 14:20; Buchwald et al., 1980, Surgery 88:507; Saudek et al., 1989, N. Engl. J. Med. 321:574). Polymeric materials can be used to achieve controlled or sustained release of the therapies of the disclosure (see, e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, 1983, J., Macromol. Sci. Rev. Macromol. Chem. 23:61; see also Levy et al., 1985, Science 228:190; During et al., 1989, Ann. Neurol. 25:351; Howard et al., 1989, J. Neurosurg. 71:105); U.S. Pat. Nos. 5,679,377; 5,916,597; 5,912,015; 5,989,463; 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly (acrylic acid), poly(ethylene-co-vinyl acetate), poly(methacrylic acid), polyglycolides (PLG), polyanhydrides, poly (N-vinyl pyrrolidone), poly(vinyl alcohol), polyacrylamide, poly(ethylene glycol), polylactides (PLA), poly(lactide-co-glycolides) (PLGA), and polyorthoesters. In one embodiment, the polymer used in a sustained release formulation is inert, free of leachable impurities, stable on storage, sterile, and biodegradable. A controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990, Science 249:1527-1533). Any technique known to one of skill in the art can be used to produce sustained release formulations comprising one or more MBMs of the disclosure. See, e.g., U.S. Pat. No. 4,526,938, PCT publication WO 91/05548, PCT publication WO 96/20698, Ning et al., 1996, Radiotherapy & Oncology 39:179-189, Song et al., 1995, PDA Journal of Pharmaceutical Science & Technology 50:372-397, Cleek et al., 1997, Pro. Intl Symp. Control. Rel. Bioact. Mater. 24:853-854, and Lam et al., 1997, Proc. Intl Symp. Control Rel. Bioact. Mater. 24:759-760.

If the MBMs are administered topically, they can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). For non-sprayable topical dosage forms, viscous to semi-solid or solid forms comprising a carrier or one or more excipients compatible with topical application and having a dynamic viscosity, in some instances, greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations where the active ingredient, in some instances, in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms if desired. Examples of such additional ingredients are well-known.

If the compositions comprising the MBMs are administered intranasally, the MBMs can be formulated in an aerosol form, spray, mist or in the form of drops. In particular, prophylactic or therapeutic agents for use according to the present disclosure can be conveniently delivered in the form of an aerosol spray presentation from pressurized packs or a nebulizer, with the use of a suitable propellant (e.g., dichlorodifluoromethane, trichlorofluoromethane, dichlorotetrafluoroethane, carbon dioxide or other suitable gas). In the case of a pressurized aerosol the dosage unit can be determined by providing a valve to deliver a metered amount. Capsules and cartridges (composed of, e.g., gelatin) for use in an inhaler or insufflator can be formulated containing a powder mix of the compound and a suitable powder base such as lactose or starch.

The MBMs (e.g., TBMs) can be administered in combination therapy regimens, as described in Section 7.13, infra.

In certain embodiments, the MBMs can be formulated to ensure proper distribution in vivo. For example, the blood-brain barrier (BBB) excludes many highly hydrophilic compounds. To ensure that the therapeutic compounds of the disclosure cross the BBB (if desired), they can be formulated, for example, in liposomes. For methods of manufacturing liposomes, see, e.g., U.S. Pat. Nos. 4,522,811; 5,374,548; and 5,399,331. The liposomes can comprise one or more moieties which are selectively transported into specific cells or organs, thus enhance targeted drug delivery (see, e.g., Ranade, 1989, J. Clin. Pharmacol. 29:685). Exemplary targeting moieties include folate or biotin (see, e.g., U.S. Pat. No. 5,416,016 to Low et al.); mannosides (Umezawa et al., 1988, Biochem. Biophys. Res. Commun. 153:1038); antibodies (Bloeman et al., 1995, FEBS Lett. 357:140; Owais et al., 1995, Antimicrob. Agents Chemother. 39:180); surfactant protein A receptor (Briscoe et al., 1995, Am. J. Physiol. 1233:134); p 120 (Schreier et al., 1994, J. Biol. Chem. 269:9090); see also Keinanen and Laukkanen, 1994, FEBS Lett. 346:123; Killion and Fidler, 1994, Immunomethods 4:273.

When used in combination therapy, e.g., as described in Section 7.13, infra, a MBM and one or more additional agents can be administered to a subject in the same pharmaceutical composition. Alternatively, the MBM and the additional agent(s) of the combination therapies can be administered concurrently to a subject in separate pharmaceutical compositions.

The therapeutic methods described herein can further comprise carrying out a "companion diagnostic" test whereby a sample from a subject who is a candidate for therapy with a MBM is tested for the expression of BCMA and/or a TAA targeted by the MBM. The companion diagnostic test can be performed prior to initiating therapy with a MBM and/or during a therapeutic regimen with a MBM to monitor the subject's continued suitability for MBM therapy. The agent used in the companion diagnostic can be the MBM itself or another diagnostic agent, for example a labeled monospecific antibody against BCMA or the TAA recognized by the MBM or a nucleic acid probe to detect TAA RNA. The sample that can be tested in a companion diagnostic assay can be any sample in which the cells targeted by the MBM can be present, from example a tumor (e.g., a solid tumor) biopsy, lymph, stool, urine, blood or any other bodily fluid that might contain circulating tumor cells.

7.12. Therapeutic Indications

The MBMs can be used in the treatment of any disease associated with BCMA expression. For example, a MBM can be used to treat a subject who has undergone treatment for a disease associated with elevated expression of BCMA, where the subject who has undergone treatment for elevated levels of BCMA exhibits a disease associated with elevated levels of BCMA.

In one aspect, the disclosure provides a method of inhibiting growth of a BCMA-expressing tumor cell, comprising contacting the tumor cell with a MBM such that the growth of the tumor cell is inhibited.

In one aspect, the disclosure provides a method of treating and/or preventing a disease that arises in individuals who are immunocompromised, comprising administering a MBM of the disclosure. In particular, disclosed herein is a method of treating diseases, disorders and conditions associated with expression of BCMA, comprising administering a MBM of the disclosure.

In certain aspects, disclosed herein is a method of treating patients at risk for developing diseases, disorders and conditions associated with expression of BCMA, comprising administering a MBM of the disclosure.

Thus, the present disclosure provides methods for the treatment or prevention of diseases, disorders and conditions associated with expression of BCMA comprising administering to a subject in need thereof, a therapeutically effective amount of a MBM of the disclosure.

The present disclosure also provides methods for preventing, treating and/or managing a disease associated with BCMA-expressing cells (e.g., a hematologic cancer or atypical cancer expressing BCMA), the methods comprising administering to a subject in need a MBM. In one aspect, the subject is a human. Non-limiting examples of disorders associated with BCMA-expressing cells include viral or fungal infections, and disorders related to mucosal immunity.

7.12.1. Cancer and Cancer-Related Diseases and Disorders

In one aspect, the disclosure provides a method of treating cancer in a subject. The method comprises administering to the subject a MBM such that the cancer is treated in the subject. An example of a cancer that is treatable by the MBM is a cancer associated with expression of BCMA.

In one aspect, the disclosure provides methods for treating a cancer where part of the tumor is negative for BCMA and part of the tumor is positive for BCMA.

In one aspect, the disclosure provides methods for treating a cancer where BCMA is expressed on both normal cells and cancers cells, but is expressed at lower levels on normal cells, using a MBM of the disclosure. In one embodiment, the method further comprises selecting a MBM that binds with an affinity that allows the MBM to bind and kill the cancer cells expressing BCMA but kill less than 30%, 25%, 20%, 15%, 10%, 5% or less of the normal cells expressing BCMA, e.g., as determined by an assay described herein. For example, a killing assay such as flow cytometry based on Cr51 CTL can be used. In one embodiment, the MBM has an ABM1 that has a binding affinity $K_D$ of $10^{-4}$ M to $10^{-8}$ M, e.g., $10^{-5}$ M to $10^{-7}$ M, e.g., $10^{-6}$ M or $10^{-7}$ M, for BCMA.

In one aspect, disclosed herein is a method of treating a proliferative disease such as a cancer or malignancy or a precancerous condition such as a myelodysplasia, a myelodysplastic syndrome or a preleukemia, comprising administering a MBM. In one aspect, the cancer is a hematological cancer. Hematological cancer conditions are the types of cancer such as leukemia and malignant lymphoproliferative conditions that affect blood, bone marrow and the lymphatic system. In one aspect, the hematological cancer is a leukemia. An example of a disease or disorder associated with BCMA is multiple myeloma (also known as MM) (See Claudio et al., Blood. 2002, 100(6):2175-86; and Novak et al., Blood. 2004, 103(2):689-94). Multiple myeloma, also known as plasma cell myeloma or Kahler's disease, is a cancer characterized by an accumulation of abnormal or malignant plasma B-cells in the bone marrow. Frequently, the cancer cells invade adjacent bone, destroying skeletal structures and resulting in bone pain and fractures. Most cases of myeloma also feature the production of a paraprotein (also known as M proteins or myeloma proteins), which is an abnormal immunoglobulin produced in excess by the clonal proliferation of the malignant plasma cells. Blood serum paraprotein levels of more than 30 g/L is diagnostic of multiple myeloma, according to the diagnostic criteria of the International Myeloma Working Group (IMWG) (See Kyle et al. (2009), Leukemia. 23:3-9). Other symptoms or signs of multiple myeloma include reduced kidney function or renal failure, bone lesions, anemia, hypercalcemia, and neurological symptoms.

Other plasma cell proliferative disorders that can be treated by the compositions and methods described herein include, but are not limited to, asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

Another example of a disease or disorder associated with BCMA is Hodgkin's lymphoma and non-Hodgkin's lymphoma (See Chiu et al., Blood. 2007, 109(2):729-39; He et al., J Immunol. 2004, 172(5):3268-79).

Hodgkin's lymphoma (HL), also known as Hodgkin's disease, is a cancer of the lymphatic system that originates from white blood cells, or lymphocytes. The abnormal cells that comprise the lymphoma are called Reed-Sternberg cells. In Hodgkin's lymphoma, the cancer spreads from one lymph node group to another. Hodgkin's lymphoma can be subclassified into four pathologic subtypes based upon Reed-Sternberg cell morphology and the cell composition around the Reed-Sternberg cells (as determined through lymph node biopsy): nodular sclerosing HL, mixed-cellularity subtype, lymphocyte-rich or lymphocytic predominance, lymphocyte depleted. Some Hodgkin's lymphoma can also be nodular lymphocyte predominant Hodgkin's lymphoma, or can be unspecified. Symptoms and signs of Hodgkin's lymphoma include painless swelling in the lymph nodes in the neck, armpits, or groin, fever, night sweats, weight loss, fatigue, itching, or abdominal pain.

Non-Hodgkin's lymphoma (NHL) comprises a diverse group of blood cancers that include any kind of lymphoma other than Hodgkin's lymphoma. Subtypes of non-Hodgkin's lymphoma are classified primarily by cell morphology, chromosomal aberrations, and surface markers. NHL subtypes (or NHL-associated cancers) include B cell lymphomas such as, but not limited to, Burkitt's lymphoma, B-cell chronic lymphocytic leukemia (B-CLL), B-cell prolymphocytic leukemia (B-PLL), chronic lymphocytic leukemia (CLL), diffuse large B-cell lymphoma (DLBCL) (e.g., intravascular large B-cell lymphoma and primary mediastinal B-cell lymphoma), follicular lymphoma (e.g., follicle center lymphoma, follicular small cleaved cell), hair cell leukemia, high grade B-cell lymphoma (Burkitt's like), lymphoplasmacytic lymphoma (Waldenstrom's macroglublinemia), mantle cell lymphoma, marginal zone B-cell lymphomas (e.g., extranodal marginal zone B-cell lymphoma or mucosa-associated lymphoid tissue (MALT) lymphoma, nodal marginal zone B-cell lymphoma, and splenic marginal zone B-cell lymphoma), plasmacytoma/myeloma, precursor B-lymphoblastic leukemia/lymphoma (PB-LBL/L), primary central nervous system (CNS) lymphoma, primary intraocular lymphoma, small lymphocytic lymphoma (SLL); and T cell lymphomas, such as, but not limited to, anaplastic large cell lymphoma (ALCL), adult T-cell lymphoma/leukemia (e.g., smoldering, chronic, acute and lymphomatous), angiocentric lymphoma, angioimmunoblastic T-cell lymphoma, cutaneous T-cell lymphomas (e.g., mycosis fungoides, Sezary syndrome, etc.), extranodal natural killer/T-cell lymphoma (nasal-type), enteropathy type intestinal T-cell lymphoma, large granular lymphocyte leukemia, precursor T-lymphoblastic lymphoma/leukemia (T-LBL/L), T-cell chronic lymphocytic leukemia/prolymphocytic leukemia (T-CLL/PLL), and unspecified peripheral T-cell lymphoma. Symptoms and signs of Hodgkin's lymphoma include painless swelling in the lymph nodes in the neck, armpits, or groin, fever, night sweats, weight loss, fatigue, itching, abdominal pain, coughing, or chest pain.

BCMA expression has also been associated with Waldenstrom's macroglobulinemia (WM), also known as lymphoplasmacytic lymphoma (LPL). (See Elsawa et al., Blood. 2006, 107(7):2882-8). Waldenstrom's macroglobulinemia was previously considered to be related to multiple myeloma, but has more recently been classified as a subtype of non-Hodgkin's lymphoma. WM is characterized by uncontrolled B-cell lymphocyte proliferation, resulting in anemia and production of excess amounts of paraprotein, or immunoglobulin M (IgM), which thickens the blood and results in hyperviscosity syndrome. Other symptoms or signs of WM include fever, night sweats, fatigue, anemia, weight loss, lymphadenopathy or splenomegaly, blurred vision, dizziness, nose bleeds, bleeding gums, unusual bruises, renal impairment or failure, amyloidosis, or peripheral neuropathy.

Another example of a disease or disorder associated with BCMA expression is brain cancer. Specifically, expression of BCMA has been associated with astrocytoma or glioblastoma (See Deshayes et al, Oncogene. 2004, 23(17):3005-12, Pelekanou et al., PLoS One. 2013, 8(12):e83250). Astrocytomas are tumors that arise from astrocytes, which are a type of glial cell in the brain. Glioblastoma (also known as glioblastoma multiforme or GBM) is the most malignant form of astrocytoma, and is considered the most advanced stage of brain cancer (stage IV). There are two variants of glioblastoma: giant cell glioblastoma and gliosarcoma. Other astrocytomas include juvenile pilocytic astrocytoma (JPA), fibrillary astrocytoma, pleomorphic xantroastrocytoma (PXA), desembryoplastic neuroepithelial tumor (DNET), and anaplastic astrocytoma (AA).

Symptoms or signs associated with glioblastoma or astrocytoma include increased pressure in the brain, headaches, seizures, memory loss, changes in behavior, loss in movement or sensation on one side of the body, language dysfunction, cognitive impairments, visual impairment, nausea, vomiting, and weakness in the arms or legs.

Surgical removal of the tumor (or resection) is the standard treatment for removal of as much of the glioma as possible without damaging or with minimal damage to the normal, surrounding brain. Radiation therapy and/or chemotherapy are often used after surgery to suppress and slow recurrent disease from any remaining cancer cells or satellite lesions. Radiation therapy includes whole brain radiotherapy (conventional external beam radiation), targeted three-dimensional conformal radiotherapy, and targeted radionuclides. Chemotherapeutic agents commonly used to treat glioblastoma include temozolomide, gefitinib or erlotinib, and cisplatin. Angiogenesis inhibitors, such as Bevacizumab (Avastin®), are also commonly used in combination with chemotherapy and/or radiotherapy.

Supportive treatment is also frequently used to relieve neurological symptoms and improve neurologic function, and is administered in combination any of the cancer therapies described herein. The primary supportive agents include anticonvulsants and corticosteroids. Thus, the compositions and methods of the present disclosure can be used in combination with any of the standard or supportive treatments to treat a glioblastoma or astrocytoma.

The present disclosure provides for compositions and methods for treating cancer. In one aspect, the cancer is a hematologic cancer including but not limited to a leukemia or a lymphoma. In one aspect, disclosed herein are methods of treating cancers and malignancies including, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further diseases associated with BCMA expression include, but are not limited to, e.g., atypical and/or non-classical cancers, malignancies, precancerous conditions or proliferative diseases expressing BCMA.

In some embodiments, a MBM of the disclosure can be used to treat a disease including but not limited to a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

In some embodiments, a MBM can be used to treat a disease including but not limited to a cancer, e.g., a cancer described herein, e.g., a prostate cancer (e.g., castrate-resistant or therapy-resistant prostate cancer, or metastatic prostate cancer), pancreatic cancer, or lung cancer.

The present disclosure also provides methods for inhibiting the proliferation or reducing a BCMA-expressing cell population, the methods comprising contacting a population of cells comprising a BMCA-expressing cell with a MBM of the disclosure. In an aspect, the present disclosure provides methods for inhibiting the proliferation or reducing the population of cancer cells expressing BCMA, the methods comprising contacting the BCMA-expressing cancer cell population with a MBM. In one aspect, the disclosure provides methods for inhibiting the proliferation or reducing the population of cancer cells expressing BCMA, the methods comprising contacting the BMCA-expressing cancer cell population with a MBM. In certain aspects, the methods reduce the quantity, number, amount or percentage of cells and/or cancer cells by at least 25%, at least 30%, at least 40%, at least 50%, at least 65%, at least 75%, at least 85%, at least 95%, or at least 99% in a subject with or an animal model for myeloid leukemia or another cancer associated with BCMA-expressing cells relative to a negative control. In one aspect, the subject is a human.

The present disclosure provides methods for preventing relapse of cancer associated with BCMA-expressing cells, the methods comprising administering to a subject in need thereof a MBM.

7.12.2. Non-Cancer Related Diseases and Disorders

Non-cancer related diseases and disorders associated with BCMA expression can also be treated by the compositions and methods disclosed herein. Examples of non-cancer related diseases and disorders associated with BCMA expression include, but are not limited to: viral infections; e.g., HIV, fungal infections, e.g., C. neoformans; and autoimmune diseases.

Autoimmune disorders that can be treated with the MBMs of the disclosure include systemic lupus erythematosus (SLE), Sjögren's syndrome, scleroderma, rheumatoid arthritis (RA), juvenile idiopathic arthritis, graft versus host disease, dermatomyositis, type I diabetes mellitus, Hashimoto's thyroiditis, Graves's disease, Addison's disease, celiac disease, disorders related to mucosal immunity, irritable bowel diseases (e.g., Crohn's Disease, ulcerative colitis), pernicious anaemia, pemphigus vulgaris, vitiligo, autoimmune haemolytic anaemia, idiopathic thrombocytopenic purpura, giant cell arteritis, myasthenia gravis, multiple sclerosis (MS) (e.g., relapsing-remitting MS (RRMS)), glomerulonephritis, Goodpasture's syndrome, bullous pemphigoid, colitis ulcerosa, Guillain-Barré syndrome, chronic inflammatory demyelinating polyneuropathy, anti-phospholipid syndrome, narcolepsy, sarcoidosis, and Wegener's granulomatosis.

In some embodiments, the MBMs of the disclosure are used to treat systemic lupus erythematosus (SLE).

In some embodiments, the MBMs of the disclosure are used to treat Sjögren's syndrome.

In some embodiments, the MBMs of the disclosure are used to treat scleroderma.

In some embodiments, the MBMs of the disclosure are used to treat rheumatoid arthritis (RA).

In some embodiments, the MBMs of the disclosure are used to treat juvenile idiopathic arthritis.

In some embodiments, the MBMs of the disclosure are used to treat graft versus host disease.

In some embodiments, the MBMs of the disclosure are used to treat dermatomyositis.

In some embodiments, the MBMs of the disclosure are used to treat type I diabetes mellitus.

In some embodiments, the MBMs of the disclosure are used to treat Hashimoto's thyroiditis.

In some embodiments, the MBMs of the disclosure are used to treat Graves's disease.

In some embodiments, the MBMs of the disclosure are used to treat Addison's disease.

In some embodiments, the MBMs of the disclosure are used to treat celiac disease.

In some embodiments, the MBMs of the disclosure are used to treat Crohn's Disease.

In some embodiments, the MBMs of the disclosure are used to treat pernicious anaemia.

In some embodiments, the MBMs of the disclosure are used to treat pemphigus vulgaris.

In some embodiments, the MBMs of the disclosure are used to treat vitiligo.

In some embodiments, the MBMs of the disclosure are used to treat autoimmune haemolytic anaemia.

In some embodiments, the MBMs of the disclosure are used to treat idiopathic thrombocytopenic purpura.

In some embodiments, the MBMs of the disclosure are used to treat giant cell arteritis.

In some embodiments, the MBMs of the disclosure are used to treat myasthenia gravis.

In some embodiments, the MBMs of the disclosure are used to treat multiple sclerosis (MS). In some embodiments, the MS is relapsing-remitting MS (RRMS).

In some embodiments, the MBMs of the disclosure are used to treat glomerulonephritis.

In some embodiments, the MBMs of the disclosure are used to treat Goodpasture's syndrome.

In some embodiments, the MBMs of the disclosure are used to treat bullous pemphigoid.

In some embodiments, the MBMs of the disclosure are used to treat colitis ulcerosa.

In some embodiments, the MBMs of the disclosure are used to treat Guillain-Barré syndrome.

In some embodiments, the MBMs of the disclosure are used to treat chronic inflammatory demyelinating polyneuropathy.

In some embodiments, the MBMs of the disclosure are used to treat anti-phospholipid syndrome.

In some embodiments, the MBMs of the disclosure are used to treat narcolepsy.

In some embodiments, the MBMs of the disclosure are used to treat sarcoidosis.

In some embodiments, the MBMs of the disclosure are used to treat Wegener's granulomatosis.

7.13. Combination Therapy

A MBM (e.g., a TBM) of the disclosure can be used in combination with other known agents and therapies. For example, the MBMs can be used in treatment regimens in combination with surgery, chemotherapy, antibodies, radiation, peptide vaccines, steroids, cytoxins, proteasome inhibitors, immunomodulatory drugs (e.g., IMiDs), BH3 mimetics, cytokine therapies, stem cell transplant or any combination thereof. Without being bound by theory, it is believed that one of the advantages of the MBMs of the disclosure is that they can circumvent the need for administering separate antibodies to a subject suffering from a cancer (e.g., a B cell malignancy). Accordingly, in certain embodiments, the one or more additional agents do not include an antibody (e.g., rituximab).

For convenience, an agent that is used in combination with a MBM is referred to herein as an "additional" agent.

Administered "in combination," as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". For example, each therapy can be administered to a subject at the same time or sequentially in any order at different points in time; however, if not administered at the same time, they should be administered sufficiently close in time so as to provide the desired therapeutic effect.

A MBM and one or more additional agents can be administered simultaneously, in the same or in separate compositions, or sequentially. For sequential administration, the MBM can be administered first, and the additional agent can be administered second, or the order of administration can be reversed.

The MBM and the additional agent(s) can be administered to a subject in any appropriate form and by any suitable route. In some embodiments, the routes of administration are the same. In other embodiments the routes of administration are different.

In other embodiments, the delivery of one treatment ends before the delivery of the other treatment begins.

In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The MBMs and/or additional agents can be administered during periods of active disorder, or during a period of remission or less active disease. A MBM can be administered before the treatment with the additional agent(s), concurrently with the treatment with the additional agent(s), post-treatment with the additional agent(s), or during remission of the disorder.

When administered in combination, the MBM and/or the additional agent(s) can be administered in an amount or dose that is higher, lower or the same than the amount or dosage of each agent used individually, e.g., as a monotherapy.

The additional agent(s) of the combination therapies of the disclosure can be administered to a subject concurrently. Each therapy can be administered to a subject together or separately, in any appropriate form and by any suitable route.

The MBM and the additional agent(s) can be administered to a subject by the same or different routes of administration.

The MBMs and the additional agent(s) can be cyclically administered. Cycling therapy involves the administration of a first therapy (e.g., a first prophylactic or therapeutic agent) for a period of time, followed by the administration of a second therapy (e.g., a second prophylactic or therapeutic agent) for a period of time, optionally, followed by the administration of a third therapy (e.g., prophylactic or therapeutic agent) for a period of time and so forth, and repeating this sequential administration, i.e., the cycle in order to reduce the development of resistance to one of the therapies, to avoid or reduce the side effects of one of the therapies, and/or to improve the efficacy of the therapies.

In certain instances, the one or more additional agents, are other anti-cancer agents, anti-allergic agents, anti-nausea agents (or anti-emetics), pain relievers, cytoprotective agents, and combinations thereof.

In one embodiment, a MBM is administered in combination with an anti-cancer agent (e.g., a chemotherapeutic agent). Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzamab, gemtuzumab, rituximab, tositumomab, obinutuzumab, ofatumumab, daratumumab, elotuzumab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immuno-modulator such as thalidomide or a thalidomide derivative (e.g., lenalidomide).

General chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Plati-nol®), cladribine (Leustatin®), cyclophosphamide (Cy-toxan® or Neosar®), cytarabine, cytosine arabinoside (Cy-tosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydro-chloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camp-tosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), tenipo-side (Vumon®), 6-thioguanine, thiotepa, tirapazamine (Tira-zone®), topotecan hydrochloride for injection (Hycamp-tin®), vinblastine (Velban®), vincristine (Oncovin®), and vinorelbine (Navelbine®).

Anti-cancer agents of particular interest for combinations with the MBMs of the present disclosure include: anthra-cyclines; alkylating agents; antimetabolites; drugs that inhibit either the calcium dependent phosphatase calcineurin or the p70S6 kinase FK506) or inhibit the p70S6 kinase; mTOR inhibitors; immunomodulators; vinca alkaloids; pro-teasome inhibitors; GITR agonists (e.g., GWN323); protein tyrosine phosphatase inhibitors; a CDK4 kinase inhibitor; a BTK inhibitor; a MKN kinase inhibitor; a DGK kinase inhibitor; an oncolytic virus; a BH3 mimetic; and cytokine therapies.

A MBM can be administered in combination with one or more anti-cancer agents that prevent or slow shedding of an antigen targeted by one or more of the ABMs of the MBM, thereby reducing the amount of soluble antigen and/or increasing the amount of cell surface bound antigen. For example, MBMs can be administered in combination with an ADAM10/17 inhibitor (e.g., INCB7839), e.g., to block shedding of an antigen released from cancer a cell by ADAM10/17, or in combination with a phospholipase inhibitor, e.g., to block shedding of an antigen released from a cancer cell by a phospholipase. Also of particular interest for combinations with the MBMs of the present disclosure are gamma secretase modulators such as gamma secretase inhibitors (GSIs).

Exemplary alkylating agents include, without limitation, nitrogen mustards, ethylenimine derivatives, alkyl sulfonates, nitrosoureas and triazenes): uracil mustard (Ami-nouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramus-tin®, Uramustine®), chlormethine (Mustargen®), cyclo-phosphamide (Cytoxan®, Neosar®, Clafen®, Endoxan®, Procytox®, Revimmune™), ifosfamide (Mitoxana®), mel-phalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temo-zolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmela-mine (HMM), Hexalen®); Carmustine (BiCNU®); Benda-mustine (Treanda®); Busulfan (Busulfex® and Myleran®); Carboplatin (Paraplatin®); Lomustine (also known as CCNU, CeeNU®); Cisplatin (also known as CDDP, Plati-nol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethyl-melamine (HMM), Hexalen®); Ifosfamide (Ifex®); Prednu-mustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Ben-damustine HCI (Treanda®).

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R, 23S,24E, 26E,28Z,30S,32S,35R)-1,18-dihydroxy-19,30-dimethoxy-15,17,21,23, 29,35-hexamethyl-2,3,10,14,20-pentaoxo-11, 36-dioxa-4-azatricyclo[30.3.1.04,9] hexatriaconta-16,24,26, 28-tetraen-12-yl]propyl]-2-methoxycyclohexyl dimethylphosphinate, also known as AP23573 and MK8669, and described in PCT Publication No. WO3/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl] pyrido[2,3-d]pyrimidin-7-yl}-2-methoxyphenyl)methanol (AZD8055); 2-Amino-8-[trans-4-(2-hydroxyethoxy)cyclo-hexyl]-6-(6-methoxy-3-pyridinyl)-4-methyl-pyrido[2,3-d] pyrimidin-7(8H)-one (PF04691502, CAS 1013101-36-4); and N2-[1,4-dioxo-4-[[4-(4-oxo-8-phenyl-4H-1-benzopy-ran-2-yl)morpholinium-4-yl]methoxy]butyl]-L-argin-ylglycyl-L-α-aspartylL-serine- (SEQ ID NO: 555), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); IMIDs (such as tha-lidomide (Thalomid®), lenalidomide, pomalidomide, and apremilast), actimid (CC4047); and IRX-2 (mixture of human cytokines including interleukin 1, interleukin 2, and interferon γ, CAS 951209-71-5, available from IRX Thera-peutics).

Exemplary anthracyclines include, e.g., doxorubicin (Adriamycin® and Rubex®); bleomycin (Ienoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (El-lence™); idarubicin (Idamycin®, Idamycin PFS®); mito-mycin C (Mutamycin®); geldanamycin; herbimycin; ravidomycin; and desacetylravidomycin.

Exemplary vinca alkaloids include, e.g., vinorelbine tar-trate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteasome inhibitors include bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

Exemplary BH3 mimetics include venetoclax, ABT-737 (4-{4-[(4'-Chloro-2-biphenyl)methyl]-1-piperazinyl}-N-[(4-{[(2R)-4-(dimethylamino)-1-(phenylsulfanyl)-2-butanyl]amino}-3-nitrophenyl)sulfonyl]benzamide and navitoclax (formerly ABT-263).

Exemplary cytokine therapies include interleukin 2 (IL-2) and interferon-alpha (IFN-alpha).

In certain aspects, "cocktails" of different chemotherapeutic agents are administered as the additional agent(s).

In one aspect, the disclosure provides a method for treating subjects that have a disease associated with expression of BCMA, comprising administering to the subject an effective amount of: (i) a MBM of the disclosure, and (ii) a gamma secretase inhibitor (GSI).

In one aspect, the disclosure provides a method for treating subjects that have undergone treatment for a disease associated with expression of BCMA, comprising administering to the subject an effective amount of: (i) a MBM of the disclosure, and (ii) a GSI.

In one embodiment, the MBM and the GSI are administered simultaneously or sequentially. In one embodiment, the MBM is administered prior to the administration of the GSI. In one embodiment, the GSI is administered prior to the administration of the MBM. In one embodiment, the MBM and the GSI are administered simultaneously.

In one embodiment, the GSI is administered prior to the administration of the MBM (e.g., GSI is administered 1, 2, 3, 4, or 5 days prior to the administration of the MBM), optionally where after the administration of the GSI and prior to the administration of the MBM, the subject shows an increase in cell surface BCMA expression levels and/or a decrease in soluble BCMA levels.

In some embodiments, the GSI is a small molecule that reduces the expression and/or function of gamma secretase, e.g., a small-molecule GSI disclosed herein. In one embodiment, the GSI is chosen from LY-450139, PF-5212362, BMS-708163, MK-0752, ELN-318463, BMS-299897, LY-411575, DAPT, BMS-906024, PF-3084014, R04929097, and LY3039478. In one embodiment, the GSI is chosen from PF-5212362, ELN-318463, BMS-906024, and LY3039478. Exemplary GSIs are disclosed in Takebe et al., Pharmacol Ther. 2014 February; 141(2):140-9; and Ran et al., EMBO Mol Med. 2017 July; 9(7):950-966.

In some embodiments, MK-0752 is administered in combination with docetaxel. In some embodiments, MK-0752 is administered in combination with gemcitabine. In some embodiments, BMS-906024 is administered in combination with chemotherapy.

In some embodiments, the GSI can be a compound of formula (I) or a pharmaceutically acceptable salt thereof;

(I)

where ring A is aryl or heteroaryl; each of $R^1$, $R^2$, and $R^4$ is independently hydrogen, $C_1$-$C_6$ alkyl, cycloalkyl, heterocyclyl, cycloalkylalkyl, heterocyclylalkyl, aryl, heteroaryl, aralkyl, or heteroaralkyl, where each $C_1$-$C_6$ alkyl, cycloalkyl, heterocyclyl, cycloalkylalkyl, heterocyclylalkyl, aryl, heteroaryl, aralkyl, or heteroaralkyl is substituted with 0-6 independent occurrences of halogen, —$OR^A$, —$SR^A$, —$C(O)OR^A$, —$C(O)N(R^A)(R^B)$, —$N(RA)(RB)$,or —$C(NR^C)N(R^A)(R^B)$; each $R^{3a}$, $R^{3b}$, $R^{6a}$, and $R^{5b}$ is independently hydrogen, halogen, —OH, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl is substituted with 0-6 independent occurrences of halogen, —OH, —$OR^A$, —$SR^A$, —$C(O)OR^A$, —$C(O)N(R^A)(R^B)$, —$N(R^A)(R^B)$,or —$C(NR^C)N(R^A)(R^B)$; $R^6$ is hydrogen, $C_1$-$C_6$ alkyl, cycloalkyl, heterocyclyl, cycloalkylalkyl, heterocyclylalkyl, aryl, heteroaryl, aralkyl, or heteroaralkyl, where each $C_1$-$C_6$ alkyl, cycloalkyl, heterocyclyl, cycloalkylalkyl, heterocyclylalkyl, aryl, heteroaryl, aralkyl, or heteroaralkyl is substituted with 0-6 independent occurrences of halogen, —OH, or $C_1$-$C_6$ alkoxy; and each $R^A$, $R^B$, and $R^C$ is independently hydrogen, $C_1$-$C_6$ alkyl, cycloalkyl, heterocyclyl, cycloalkylalkyl, heterocyclylalkyl, aryl, heteroaryl, aralkyl, or heteroaralkyl, where each $C_1$-$C_6$ alkyl, cycloalkyl, heterocyclyl, cycloalkylalkyl, heterocyclylalkyl, aryl, heteroaryl, aralkyl, or heteroaralkyl is substituted with 0-6 independent occurrences of halogen, —OH, or $C_1$-$C_6$ alkoxy.

In some embodiments, ring A is aryl (e.g., phenyl). In some embodiments, $R^1$ is —$CH_3$. In some embodiments, each of $R^2$ and $R^4$ is independently hydrogen. In some embodiments, $R^{3a}$ is —$CH_3$ and $R^{3b}$ is hydrogen. In some embodiments, $R^{5a}$ is hydrogen and $R^{5b}$ is —$CH(CH_3)_2$. In some embodiments, $R^6$ is hydrogen.

In a further embodiment, the GSI is a compound described in U.S. Pat. No. 7,468,365. In one embodiment, the GSI is LY-450139, i.e., semagacestat, (S)-2-hydroxy-3-methyl-N—((S)-1-(((S)-3-methyl-2-oxo-2,3,4,5-tetrahydro-1H-benzo[d]azepin-1-yl)amino)-1-oxopropan-2-yl)butanamide, or a pharmaceutically acceptable salt thereof. In one embodiment, the GSI is or a pharmaceutically acceptable salt thereof.

In some embodiments, the GSI is a compound of formula (II) or a pharmaceutically acceptable salt thereof;

(II)

where ring B is aryl or heteroaryl; L is a bond, $C_1$-$C_6$ alkylene, —S(O)$_2$—, —C(O)—, —N($R^E$)(O)C—, or —OC (O)—; each $R^7$ is independently halogen, —OH, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl is independently substituted with 0-6 occurrences of halogen, —OR$^D$, —SR$^D$, —C(O)OR$^D$, —C(O)N(R$^D$)(R$^E$), —N(R$^D$)(R$^E$), or —C(NR$^F$)N(R$^D$)(R$^E$); $R^8$ is hydrogen, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl is substituted with 0-6 independent occurrences of halogen, —OR$^D$, —SR$^D$, —C(O)OR$^D$, —C(O)N (R$^D$)(R$^E$), —N(R$^D$)(R$^E$),or —C(NR$^F$)N(R$^D$)(R$^E$); each of R$^9$and R$^{10}$ is independently hydrogen, halogen, —OH, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, aryl, heteroaryl, aralkyl, or heteroaralkyl is substituted with 0-6 independent occurrences of halogen, —OR$^D$, —SR$^D$, —C(O)OR$^D$, —C(O)N(R$^D$)(R$^E$), —N(R$^D$) (R$^E$),or —C(NR$^J$)N(R$^G$)(R$^H$); each R$^D$, R$^E$, and RF is independently hydrogen, $C_1$-$C_6$ alkyl, cycloalkyl, heterocyclyl, cycloalkylalkyl, heterocyclylalkyl, aryl, heteroaryl, aralkyl, or heteroaralkyl, where each C $C_1$-$C_6$ alkyl, cycloalkyl, heterocyclyl, cycloalkylalkyl, heterocyclylalkyl, aryl, heteroaryl, aralkyl, or heteroaralkyl is substituted with 0-6 independent occurrences of halogen, —OH, or $C_1$-$C_6$ alkoxy; and n is 0, 1, 2, 3, 4, or 5.

In some embodiments, ring B is heteroaryl (e.g., thiofuranyl). In some embodiments, L is —S(O)$_2$. In some embodiments, R$^7$ is chloro and n is 1. In some embodiments, R$^8$ is —CH$_2$OH. In some embodiments, each of R$^9$ and R$^{10}$ is independently —CF$_3$.

In a further embodiment, the GSI is a compound described in U.S. Pat. No. 7,687,666. In one embodiment, the GSI is PF-5212362, i.e., begacestat, GSI-953, or (R)-5-chloro-N-(4,4,4-trifluoro-1-hydroxy-3-(trifluoromethyl)butan-2-yl)thiophene-2-sulfonamide, or a pharmaceutically acceptable salt thereof. In one embodiment, the GSI is or a pharmaceutically acceptable salt thereof.

In some embodiments, the GSI is a compound is a compound of formula (III) or a pharmaceutically acceptable salt thereof:

(III)

where each of rings C and D is independently aryl or heteroaryl;
each of R$^{11}$, R$^{12}$, and R$^{14}$ is independently hydrogen, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, —S(O)R$^G$—, —S(O)$_2$R$^G$—, cycloalkyl, heterocyclyl, cycloalkylalkyl, heterocyclylalkyl, aryl, heteroaryl, aralkyl, or heteroaralkyl is substituted with 0-6 independent occurrences of halogen, —OR$^G$, —SR$^G$, —C(O)OR$^G$, —C(O)N(R$^G$)(R$^H$), —N(R$^G$) (R$^H$),or —C(NR$^J$)N(R$^G$)(R$^H$); each of R$^{13a}$ and R$^{13b}$ is hydrogen, halogen, —OH, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl is substituted with 0-6 independent occurrences of halogen, —OR$^G$, —SR$^G$, —C(O)OR$^G$, —C(O)N(R$^G$)(R$^H$), —N(R$^G$)(R$^H$),or —C(NR$^J$)N(R$^G$)(R$^H$); each R$^{15}$ and R$^{16}$ is independently halogen, —OH, $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl, where each $C_1$-$C_6$ alkyl, $C_1$-$C_6$ alkoxy, cycloalkyl, heterocyclyl, cycloalkylalkyl, heterocyclylalkyl, aryl, heteroaryl, aralkyl, or heteroaralkyl is substituted with 0-6 independent occurrences of halogen, —OR$^G$, —SR$^G$, —C(O)OR$^G$, —C(O)N(R$^G$)(R$^H$), —N(R$^G$)(R$^H$),or —C(NR$^J$)N(R$^G$)(R$^H$); each R$^G$, RH, and R' is independently hydrogen, $C_1$-$C_6$ alkyl, cycloalkyl, heterocyclyl, cycloalkylalkyl, heterocyclylalkyl, aryl, heteroaryl, aralkyl, or heteroaralkyl, where each $C_1$-$C_6$ alkyl, cycloalkyl, heterocyclyl, cycloalkylalkyl, heterocyclylalkyl, aryl, heteroaryl, aralkyl, or heteroaralkyl is substituted with 0-6 independent occurrences of halogen, —OH, or $C_1$-$C_6$ alkoxy; and each of m, n, and p is independently 0, 1, 2, 3, 4, or 5.

In some embodiments, ring C is aryl (e.g., phenyl). In some embodiments, ring D is heteroaryl (e.g., 1,2,4-oxadiazole). In some embodiments, R$^{15}$ is fluoro and n is 1. In some embodiments, p is 0. In some embodiments, m is 1. In some embodiments, R$^{14}$ is —S(O)$_2$R$^G$ and R$^G$ is chlorophenyl. In some embodiments, R$^{13a}$ is —CH$_2$CH$_2$CF$_3$ and R$^{13b}$ is hydrogen. In some embodiments, each R$^{11}$ and R$^{12}$ is independently hydrogen.

In a further embodiment, the GSI is a compound described in U.S. Pat. No. 8,084,477. In one embodiment, the GSI is BMS-708163, i.e., avagacestat, or (R)-2-((4-chloro-N-(2-fluoro-4-(1,2,4-oxadiazol-3-yl)benzyl)phenyl) sulfonamido)-5,5,5-trifluoropentanamide, or a pharmaceutically acceptable salt thereof. In one embodiment, the GSI is or a pharmaceutically acceptable salt thereof.

In some embodiments, the GSI is a compound of formula (IV) or a pharmaceutically acceptable salt thereof:

(IV)

where $R^{17}$ is selected from a.

b.

c.

, and d.

$R^{18}$ is lower alkyl, lower alkinyl, —$(CH_2)_n$—O-lower alkyl, —$(CH_2)_n$—S-lower alkyl, —$(CH_2)_n$—CN, —$(CR'R")_n$—$CF_3$, —$(CR'R")_n$—$CH_2F$, —$(CR'R")$ n-$CH_2F$, —$(CH_2)_n$, —$C(O)O$-lower alkyl, —$(CH_2)_n$-halogen, or is —$(CH_2)_n$-cycloalkyl optionally substituted by one or more substituents selected from the group consisting of phenyl, halogen and $CF_3$; R',R" are each independently hydrogen, lower alkyl, lower alkoxy, halogen or hydroxy; $R^{19}$, $R^{20}$ are each independently hydrogen, lower alkyl, lower alkoxy, phenyl or halogen; $R^{21}$ is hydrogen, lower alkyl, —$(CH_2)_n$—$CF_3$ or —$(CH_2)_n$-cycloalkyl; $R^{22}$ is hydrogen or halogen; $R^{23}$ is hydrogen or lower alkyl; $R^{24}$ is hydrogen, lower alkyl, lower alkinyl, —$(CH_2)_n$—$CF_3$, —$(CH_2)_n$-cycloalkyl or —$(CH_2)_n$-phenyl optionally substituted by halogen; $R^{25}$ is hydrogen, lower alkyl, —C(O)H, —O(O)-lower alkyl, —C(O)—$CF_3$, —C(O)—$CH_2F$, —C(O)—$CHF_2$, —C(O)-cycloalkyl, —C(O)—$(CH_2)_n$—O-lower alkyl, —C(O)O—$(CH_2)_n$-cycloalkyl, —C(O)-phenyl optionally substituted by one or more substituents selected from the group consisting of halogen and —C(O)O-lower alkyl, or is —S(O)2-lower alkyl, —$S(O)_2$—$CF_3$, —$(CH_2)_n$-cycloalkyl or is —$(CH_2)_n$-phenyl optionally substituted by halogen; n is 0, 1, 2, 3 or 4.

In some embodiments, $R^{17}$ is 5,7-dihydro-6H-dibenzo[b,d]azepin-6-onyl. In some embodiments, each $R^{19}$ and $R^{20}$ is independently —$CH_3$. In some embodiments, $R^{18}$ is $CH_2CF_2CF_3$.

In some embodiments, the GSI is a compound described in U.S. Pat. No. 7,160,875. In one embodiment, the GSI is RO4929097, i.e., (S)-2,2-dimethyl-N1-(6-oxo-6,7-dihydro-5H-dibenzo[b,d]azepin-7-yl)-N3-(2,2,3,3,3-pentafluoropropyl)malonamide, or a pharmaceutically acceptable salt thereof. In one embodiment, the GSI is or a pharmaceutically acceptable salt thereof.

In some embodiments, the GSI is or a pharmaceutically acceptable salt thereof.

In some embodiments, the GSI is a compound of Formula (V) or a pharmaceutically acceptable salt thereof:

$$(V)$$

where q is 0 or 1; Z represents halogen, —CN, —$NO_2$, —$N_3$, —$CF_3$, —$OR^{2a}$, —$N(R^{2a})_2$, —$CO_2R^{2a}$, —$OR^{2a}$, —$COR^{2a}$, —$CON(R^{2a})_2$, —$OCON(R^{2a})^2$, —$CONR^{2a}$ ($OR^{2a}$), —$CON(R^{2a})_2$, —$(R^{2a})N(R^{2a})_2$, —ONHC (=NOH)$R^{2a}$, heterocyclyl, phenyl or heteroaryl, the heterocyclyl, phenyl or heteroaryl bearing 0-3 substituents selected from halogen, —CN, —$NO_2$, —$CF_3$, —$OR^{2a}$, —$N(R^{2a})_2$, —$CO_2R^{2a}$, —$COR^{2a}$, —CON ($R^{2a})_2$ and $C_{1-4}$ alkyl; $R^{27}$ represents H, $C_{1-4}$ alkyl, or OH; $R^{26}$ represents H or $C_{1-4}$ alkyl; with the proviso that when m is 1, $R^{26}$ and $R^{27}$ do not both represent $C_{1-4}$ alkyl; $Ar^1$ represents $C_{6-10}$ aryl or heteroaryl, either of which bears 0-3 substituents independently selected from halogen, —CN, —$NO_2$, —$CF_3$, —OH, —$OCF_3$, $C_{1-4}$ alkoxy or $C_{1-4}$ alkyl which optionally bears a substituent selected from halogen, CN, $NO_2$, $CF_3$, OH and $C_{1-4}$ alkoxy; $Ar^2$ represents $C_{6-10}$ aryl or heteroaryl, either of which bears 0-3 substituents independently selected from halogen, —CN, —$NO_2$, —$CF_3$, —OH, —$OCF_3$, $C_{1-4}$ alkoxy or $C_{1-4}$ alkyl which optionally bears a substituent selected from halogen, —CN, —$NO_2$, —$CF_3$, —OH and $C_{1-4}$ alkoxy; $R^{2a}$ represents H, $C_{1-6}$ alkyl, $C_{3-6}$ cycloalkyl, C3_6cycloalkyl, $C_{1-6}$ alkyl, $C_{2-6}$ alkenyl, any of which optionally bears a substituent selected from halogen, —CN, —$NO_2$, —$CF_3$, —$OR^{2b}$, —$CO_2R^{2b}$, —$N(R^{2b})_2$, —$CON(R^{2b})_2$, Ar and COAr; or $R^{2a}$ represents Ar; or two $R^{2a}$ groups together with a nitrogen atom to which they are mutually attached can complete an N-heterocyclyl group bearing 0-4 substituents independently selected from =O, =S, halogen, $C_{1-4}$ alkyl, —CN, —$NO_2$, —$CF_3$, —OH, $C_{1-4}$ alkoxy, $C_{1-4}$ alkoxycarbonyl, $CO_2H$, amino, $C_{1-4}$ alkylamino, di($C_{1-4}$ alkyl)amino, carbamoyl, Ar and COAr; $R^{2b}$ represents H, $C_{1-6}$ alkyl, $C_{3-6}$ cycloalkyl, $C_{3-6}$ cycloalkyl$C_{1-6}$ alkyl, $C_{2-6}$ alkenyl, any of which optionally bears a substituent selected from halogen, —CN, —$NO_2$, —$CF_3$, —OH, $C_{1-4}$ alkoxy, $C_{1-4}$ alkoxycarbonyl, —$CO_2H$, amino, $C_{1-4}$ alkylamino, di($C_{1-4}$ alkyl)amino, carbamoyl, Ar and COAr; or $R^{2b}$ represents Ar; or two $R^{2b}$ groups together with a nitrogen atom to which they are mutually attached can complete an N-heterocyclyl group bearing 0-4 substituents independently selected from =O, =S, halogen, $C_{1-4}$ alkyl, —CN, —$NO_2$, $CF_3$, —OH, $C_{1-4}$ alkoxy, $C_{1-4}$ alkoxycarbonyl, —$CO_2H$, amino, $C_{1-4}$ alkylamino, di($C_{1-4}$ alkyl)amino, carbamoyl, Ar and COAr; Ar represents phenyl or heteroaryl bearing 0-3 substituents selected from halogen, $C_{1-4}$ alkyl, —CN, —$NO_2$, —$CF_3$, —OH, $C_{1-4}$ alkoxy, $C_{1-4}$ alkoxycarbonyl, amino, $C_{1-4}$ alkylamino, di($C_{1-4}$ alkyl)amino, carbamoyl, $C_{1-4}$ alkylcarbamoyl and di($C_{1-4}$ alkyl)carbamoyl.

In some embodiments, q is 1. In some embodiments, Z is $CO_2H$. In some embodiments, each of $R^{27}$ and $R^{26}$ is independently hydrogen. In some embodiments, $Ar^1$ is chlorophenyl. In some embodiments, $Ar^2$ is difluorophenyl.

In some embodiments, the GSI is a compound described in U.S. Pat. No. 6,984,663. In one embodiment, the GSI is MK-0752, i.e., 3-((1S,4R)-4-((4-chlorophenyl)sulfonyl)-4-(2,5-difluorophenyl)cyclohexyl)propanoic acid, or a pharmaceutically acceptable salt thereof. In some embodiments, the GSI is or a pharmaceutically acceptable salt thereof.

In some embodiments, the GSI is a compound of formula (VI) or a pharmaceutically acceptable salt thereof.

$$(VI)$$

where A' is absent or selected from and —$S(O)_2$—;

Z is selected from —$CH_2$, —CH(OH), —CH($C_1$-$C_6$ alkyl), —CH($C_1$-$C_6$ alkoxy), —CH($NR^{33}R^{34}$), —CH ($CH_2$(OH)), —CH(CH($C_1$-$C_4$ alkyl)(OH)) and —CH (C($C_1$-$C_4$ alkyl)($C_1$-$C_4$ alkyl)(OH)), for example —CH (C($CH_3$)($CH_3$)(OH)) or —CH(C($CH_3$)($CH_2CH_3$) (OH)); $R^{27}$ is selected from $C_1$-$C_{20}$ alkyl, $C_2$-$C_{20}$ alkenyl, $C_2$-$C_{20}$ alalkynyl, $C_1$-$C_{20}$ alkoxy, $C_2$-$C_{20}$ alalkenoxy, $C_1$-$C_{20}$ hydroxyalkyl, $C_3$-$C_8$ cycloalkyl, benzo ($C_3$-$C_8$ cycloalkyl), benzo($C_3$-$C_8$ heterocycloalkyl), $C_4$-$C_8$ cycloalkenyl, ($C_5$-$C_{11}$)bi- or tricycloalkyl, benzo (C$_5$-C$_{11}$)bi- or tricycloalkyl, C$_7$-C$_{11}$ tricycloalkenyl, (3-8 membered) heterocycloalkyl, C$_6$-C$_{14}$ aryl and (5-14 membered) heteroaryl, where each hydrogen atom of the alkyl, alkenyl, alkynyl, alkoxy and alkenoxy is optionally independently replaced with halo, and where the cycloalkyl, benzo(C$_3$-C$_8$ cycloalkyl), cycloalkenyl, (3-8 membered) heterocycloalkyl, C$_6$-C$_{14}$ aryl and (5-14 membered) heteroaryl is optionally independently substituted with from one to four substituents independently selected from C$_1$-C$_{10}$ alkyl optionally substituted with from one to three halo atoms, C$_1$-C$_{10}$ alkoxy optionally substituted with from one to three halo atoms, C$_1$-C$_{10}$ hydroxyalkyl, halo, e.g., fluorine, —OH, —CN, —NR$^{33}$R$^{34}$, —C(═O) NR$^{33}$R$^{34}$, —C(═O)R$^{35}$, C$_3$-C$_8$ cycloalkyl and (3-8 membered) heterocycloalkyl; R$^{28}$ is selected from hydrogen, C$_1$-C$_6$ alkyl, C$_2$-C$_6$ alkenyl, C$_3$-C$_8$ cycloalkyl and C$_5$-C$_8$ cycloalkenyl, where R$^{28}$ is optionally independently substituted with from one to three substituents independently selected from C$_1$-C$_4$ alkyl optionally substituted with from one to three halo atoms, C$_1$-C$_4$ alkoxy optionally substituted with from one to three halo atoms, halo and —OH; or R$^{27}$ and R$^{28}$ together with the A' group when present and the nitrogen atom to which R$^{28}$ is attached, or R$^{27}$ and R$^{28}$ together with the nitrogen atom to which R$^{27}$ and R$^{28}$ are attached when A' is absent, can optionally form a four to eight membered ring; R$^{29}$ is selected from hydrogen, C$_1$-C$_6$ alkyl, C$_2$-C$_6$ alkenyl, C$_2$-C$_6$ alkynyl, C$_3$-C$_6$ cycloalkyl, C$_5$-C$_6$ cycloalkenyl and (3-8 membered) heterocycloalkyl, where the alkyl, alkenyl, alkynyl, cycloalkyl, cycloalkenyl and heterocycloalkyl are each optionally independently substituted with from one to three substituents independently selected from C$_1$-C$_4$alkoxy, halo, —OH—S(C$_1$-C$_4$)alkyl and (3-8 membered) heterocycloalkyl; R$^{30}$ is hydrogen, C$_1$-C$_6$ alkyl or halo; or R$^{29}$ and R$^{30}$ can together with the carbon atom to which they are attached optionally form a moiety selected from cyclopropyl, cyclobutyl, cyclopentyl, cyclohexyl, morpholino, piperidino, pyrrolidino, tetrahydrofuranyl and perhydro-2H-pyran, where the moiety formed by R$^{29}$ and R$^{30}$ is optionally substituted with from one to three substituents independently selected from C$_1$-C$_6$ alkyl optionally substituted with from one to three halo atoms, C$_1$-C$_6$ alkoxy optionally substituted with from one to three halo atoms, halo, —OH, —CN and allyl; R$^{31}$ is selected from hydrogen, C$_1$-C$_6$ alkyl, C$_2$-C$_6$ alkylene, C$_1$-C$_6$ alkoxy, halo, —CN, C$_3$-C$_{12}$ cycloalkyl, C$_4$-C$_{12}$ cycloalkenyl and C$_6$-C$_{10}$ aryl, (5-10 membered) heteroaryl, where the alkyl, alkylene and alkoxy of R$^{31}$are each optionally independently substituted with from one to three substituents independently selected from halo and —CN, and where the cycloalkyl, cycloalkenyl and aryl and heteroaryl of R$^{31}$are each optionally independently substituted with from one to three substituents independently selected from C$_1$-C$_4$ alkyl optionally substituted with from one to three halo atoms, C$_1$-C$_4$ alkoxy optionally substituted with from one to three halo atoms, halo and —CN; R$^{32}$ is selected from hydrogen, C$_1$-C$_{20}$ alkyl, C$_1$-C$_{20}$ alkoxy, C$_1$-C$_{20}$ hydroxyalkyl, C$_3$-C$_{12}$ cycloalkyl, C$_4$-C$_{12}$ cycloalkenyl, (C$_5$-C$_{20}$) bi- or tricycloalkyl, (C$_7$-C$_{20}$)bi- or tricycloalkenyl, (3-12 membered) heterocycloalkyl, (7-20 membered) hetero bi- or heterotricycloalkyl, C$_6$-C$_{14}$ aryl and (5-15 membered) heteroaryl, where R$^{32}$ is optionally independently substituted with from one to four substituents independently selected from C$_1$-C$_{20}$ alkyl optionally substituted with from one to three halo atoms, C$_1$-C$_{20}$ alkoxy, —OH, —CN, —NO$_2$, —NR$^{33}$R$^{34}$, —C(═O) NR$^{33}$R$^{34}$, —C(═O)R$^{35}$, —C(═O)OR$^{35}$, —S(O)$_n$NR$^{33}$R$^{34}$, —S(O)$_n$R$^{35}$, C$_3$-C$_{12}$ cycloalkyl, (4-12 membered) heterocycloalkyl optionally substituted with from one to three OH or halo groups, (4-12 membered) heterocycloalkoxy, C$_6$-C$_{14}$ aryl, (5-15 membered) heteroaryl, C$_6$-C$_{12}$ aryloxy and (5-12 membered) heteroaryloxy; or R$^{33}$ and R$^{34}$ can together with the carbon and nitrogen atoms to which they are respectively attached optionally form a (5-8 membered) heterocycloalkyl ring, a (5-8 membered) heterocycloalkenyl ring or a (6-10 membered) heteroaryl ring, where the heterocycloalkyl, heterocycloalkenyl and heteroaryl rings are each optionally independently substituted with from one to three substituents independently selected from halo, C$_1$-C$_6$ alkyl, optionally substituted with from one to three halo atoms, C$_1$-C$_6$ alkoxy optionally substituted with from one to three halo atoms, C$_1$-C$_6$ hydroxyalkyl, —OH, —(CH$_2$)$_{zero-10}$NR$^{33}$R$^{34}$, —(CH$_2$)$_{zero-10}$C(═O) NR$^{33}$R$^{34}$, —S(O)$_2$NR$^{33}$R$^{34}$ and C$_3$-C$_{12}$ cycloalkyl; R$^{33}$ and R$^{34}$ are each independently selected from hydrogen, C$_1$-C$_{10}$ alkyl where each hydrogen atom of the C$_1$-C$_{10}$ alkyl is optionally independently replaced with a halo atom, e.g., a fluorine atom, C$_2$-C$_{10}$ alkenyl, C$_2$-C$_{10}$ alkynyl, C$_1$-C$_6$ alkoxy where each hydrogen atom of the C$_1$-C$_6$ alkoxy is optionally independently replaced with a halo atom, C$_2$-C$_6$ alkenoxy, C$_2$-C$_6$ alkynoxy, —C(═O)R11, —S(O)$_n$R11, C$_3$-C$_8$ cycloalkyl, C$_4$-C$_8$ cycloalkenyl, (C$_5$-C$_{11}$)bi- or tricycloalkyl, (C$_7$-C$_{11}$)bi- or tricycloalkenyl, (3-8 membered) heterocycloalkyl, C$_6$-C$_{14}$ aryl and (5-14 membered) heteroaryl, where the alkyl and alkoxy are each optionally independently substituted with from one to three substituents independently selected from halo and —OH, and where the cycloalkyl, cycloalkenyl, bi- or tricycloalkyl, bi- or tricycloalkenyl, heterocycloalkyl, aryl and heteroaryl are each optionally independently substituted with from one to three substituents independently selected from halo, —OH, C$_1$-C$_6$ alkyl optionally independently substituted with from one to six halo atoms, C$_2$-C$_6$ alkenyl, C$_2$-C$_6$ alkynyl, C$_1$-C$_6$ alkoxy, C$_2$-C$_6$ alkenoxy, C$_2$-C$_6$ alkynoxy and C$_1$-C$_6$ hydroxyalkyl; or NR$^{33}$R$^{34}$ can form a (4-7 membered) heterocycloalkyl, where the heterocycloalkyl optionally comprises from one to two further heteroatoms independently selected from N, O, and S, and where the heterocycloalkyl optionally contains from one to three double bonds, and where the heterocycloalkyl is optionally independently substituted with from one to three substituents independently selected from C$_1$-C$_6$ alkyl optionally substituted with from one to six halo atoms, C$_2$-C$_6$ alkenyl, C$_2$-C$_6$ alkynyl, C$_1$-C$_6$ alkoxy, C$_2$-C$_6$ alkenoxy, C$_2$-C$_6$ alkynoxy, C$_1$-C$_6$ hydroxyalkyl, C$_2$-C$_6$hydroxyalkenyl, C$_2$-C$_6$hydroxyalkynyl, halo, —OH, —CN, —NO$_2$, —C(═O)R$^{35}$, —C(═O)OR$^{35}$, —S(O)$_n$R$^{35}$ and —S(O)$_n$NR$^{33}$R$^{34}$; R$^{35}$ is selected from hydrogen, C$_1$-C$_8$ alkyl, C$_3$-C$_8$ cycloalkyl, C$_4$-C$_8$ cycloalkenyl, (C$_5$-C$_{11}$)bi- or tricycloalkyl, —(C$_7$-C$_{11}$) bi- or tricycloalkenyl, (3-8 membered) heterocycloalkyl, C$_6$-C$_{10}$ aryl and (5-14 membered) heteroaryl, where the alkyl of R$^{35}$ is optionally independently substituted with from one to three substituents independently selected from —OH, —CN and C$_3$-C$_8$ cycloalkyl, and where each hydrogen atom of the alkyl is optionally independently replaced with a halo atom, e.g., a fluorine atom, and where the cylcoalkyl, cycloalkenyl, heterocycloalkyl, aryl and hetereoaryl of $R^{35}$ are each optionally independently substituted with from one to three substituents independently selected from halo, $C_1$-$C_8$ alkyl optionally substituted with from one to three halo atoms, —OH, —CN and $C_3$-$C_8$cycloalkyl; n is in each instance an integer independently selected from zero, 1, 2 and 3; and the pharmaceutically acceptable salts of such compounds.

In some embodiments, the GSI is a compound described in U.S. Pat. No. 7,795,447. In one embodiment, the GSI is PF-3084014, i.e., nirogacestat or (S)-2-(((S)-6,8-difluoro-1,2,3,4-tetrahydronaphthalen-2-yl)amino)-N-(1-(2-methyl-1-(neopentylamino)propan-2-yl)-1H-imidazol-4-yl)pentanamide, or a pharmaceutically acceptable salt thereof.

In some embodiments, the GSI is or a pharmaceutically acceptable salt thereof.

In some embodiments, the compound is a compound of formula (VII):

(VII)

or a pharmaceutically acceptable salt thereof where k is 1, 2, or 3; $R^{36}$ is aryl $C_1$-$C_8$ alkyl, aryl $C_2$-$C_6$ alkenyl, or arylalkynyl, where the aryl group is substituted with 0-5 occurrences of $C_1$-$C_6$ alkyl, $C_1$-$C_6$ alkoxy, halogen, haloalkyl, haloalkoxy, heteroaryl, heteroaryl($C_1$-$C_6$)alkoxy, arylalkoxy, aryloxy, $C_1$-$C_6$ alkoxycarbonyl, —OCH$_2$CH$_2$O—, —OCH$_2$O—, —C(O)NR$^{43}$R$^{44}$, —NHR', —NR'R", —N(R$^{16}$)C(O)R$^{17}$, heterocycloalkyl, phenyl, aryl $C_1$-$C_6$ alkanoyl, phenylalkoxy, phenyloxy, CN, —SO$_2$-aryl, —S(O)$_n$R$^{25}$, —(C$_1$-C$_4$ alkyl)-S(O)$_x$R$^{25}$, —(C$_1$-C$_4$ alkyl)-SO$_2$-aryl, OH, $C_1$-$C_6$ thioalkoxy, $C_2$-$C_6$ alkenyl, —OSO$_2$-aryl, or CO$_2$H, where each heteroaryl is independently substituted with 0-3 occurrences of $C_1$-$C_6$ alkyl, heteroaryl substituted with 0-2 occurrences of halogen, alkyl, alkoxy, haloalkyl, haloalkoxy, alkoxyalkyl or CN, $C_1$-$C_6$ alkoxy, $C_1$-$C_4$ alkoxy $C_1$-$C_4$ alkyl, $C_3$-$C_6$ cycloalkyl, halogen, or phenyl substituted with 0-5 occurrences of halogen, OH, $C_1$-$C_6$ alkyl, $C_1$-$C_4$ alkoxy, CF$_3$, OCF$_3$, CN, or $C_1$-$C_6$ thioalkoxy, where each heterocycloalkyl and aryl are independently substituted with 0-2 occurrences of halogen, alkyl, alkoxy, haloalkyl, haloalkoxy, alkoxyalkyl or CN, $C_1$-$C_6$ alkyl, $C_1$-$C_6$ alkoxy, $C_1$-$C_4$ alkoxy $C_1$-$C_4$ alkyl, $C_3$-$C_6$ cycloalkyl, halogen, or phenyl substituted with 0-5 occurrences of halogen, OH, $C_1$-$C_6$ alkyl, $C_1$-$C_4$ alkoxy, CF$_3$, OCF$_3$, CN, or $C_1$-$C_6$ thioalkoxy; $R^{16}$ is hydrogen or $C_1$-$C_6$ alkyl; $R^{17}$ is $C_1$-$C_6$ alkyl, aryl, heteroaryl, $C_1$-$C_6$ alkoxy, OH, aryloxy, heteroaryloxy, aryl($C_1$-$C_6$)alkoxy, —NR$^{18}$R$^{19}$, cycloalkyl, or arylalkyl, where the cyclic portions of each are independently substituted with 0-5 occurrences of alkyl, alkoxy, halo, haloalkyl, haloalkoxy, CN, NH$_2$, NH(alkyl), N(alkyl) (alkyl), CO$_2$H, or $C_1$-$C_6$ alkoxycarbonyl; $R^{18}$ and $R^{19}$ are independently hydrogen, $C_1$-$C_6$ alkyl, aryl, heteroaryl, heterocycloalkyl or aryl($C_1$-$C_6$)alkyl, where the cyclic portions of each are substituted with 0-3 occurrences of alkyl, alkoxy, halogen, hydroxyl, CF$_3$, or OCF$_3$; each R' is independently hydrogen, $C_1$-$C_6$ alkyl, aryl, aryl($C_1$-$C_4$)alkyl, $C_1$-$C_6$ alkanoyl, $C_3$-$C_8$ cycloalkyl, aryl($C_1$-$C_6$)alkanoyl, heterocycloalkyl, heteroaryl($C_1$-$C_4$)alkyl, —SO$_2$-alkyl, —SO$_2$-aryl, —SO$_2$-heteroaryl, heterocycloalkyl($C_1$-$C_6$)alkanoyl, or heteroaryl($C_1$-$C_6$)alkanoyl, where the alkyl portion of the alkyl and alkanoyl groups are optionally substituted with halogen or $C_1$-$C_6$ alkoxy and the aryl and heteroaryl groups are optionally substituted with alkyl, alkoxy, halogen, haloalkyl, haloalkoxy; each R" is independently hydrogen or $C_1$-$C_6$ alkyl, where the alkyl group is optionally substituted with halogen; $R^{36}$ is $C_3$-$C_7$ cycloalkyl($C_1$-$C_6$ alkyl) where the cyclic portion is substituted with 0-5 occurrences of halogen, $C_1$-$C_6$ alkyl, OH, alkoxycarbonyl, or $C_1$-$C_6$ alkoxy; or $R^{36}$ is $C_1$-$C_{14}$ alkyl, $C_2$-$C_{16}$ alkenyl, or $C_2$-$C_8$ alkynyl, each of which is substituted 0-5 occurrences of OH, halogen, $C_1$-$C_6$ alkoxy, aryl, arylalkoxy, aryloxy, heteroaryl, heterocycloalkyl, aryl($C_1$-$C_6$)alkyl, —CO$_2$($C_1$-$C_6$ alkyl), —NR'R", $C_1$-$C_6$ thioalkoxy, —NHS(O)$_x$R$^{25}$, —N(C$_1$-$C_6$ alkyl)-S(O)$_n$R$^{25}$, —S(O)$_n$R$^{25}$, —C(O)NR$^{43}$R$^{44}$, —N(R$^{16}$)C(O) NR$^{16}$R$^{17}$, or —N(R$_{16}$)C(O)R$^{17}$; where the above aryl groups are substituted with 0-3 occurrences of OH, $C_1$-$C_6$ alkoxy, $C_1$-$C_6$ alkyl, or halogen; $R^{43}$ and $R^{44}$ are independently hydrogen, $C_1$-$C_6$ alkyl, aryl, arylalkyl, heteroaryl, heteroarylalkyl, heterocycloalkyl, heterocycloalkylalkyl, arylalkanoyl, alkenyl, cycloalkyl, alkynyl, cycloalkenyl, pyridyl, imidazolyl, thiazolyl, oxazolyl, or indolyl, where each alkyl is substituted with 0-3 occurrences of NH$_2$, NH(C$_1$-$C_6$ alkyl), N(C$_1$-$C_6$ alkyl) (C$_1$-$C_6$ alkyl), OH, $C_1$-$C_6$ thioalkoxy, heterocycloalkyl, aryl, heteroaryl, CN, halogen, or alkoxy optionally substituted with OH or phenyl, where the aryl, heteroaryl and heterocycloalkyl groups are substituted with 0-3 occurrences of $C_1$-$C_4$ alkyl, $C_1$-$C_4$ alkoxy, CF$_3$, OCF$_3$, OH, halogen, thioalkoxy, phenyl or heteroaryl; or $R^{43}$, $R^{44}$, and the nitrogen to which they are attached form a heterocycloalkyl ring containing from 3 to 7 ring members, where the cyclic portions of $R^{43}$ and $R^{44}$ or the heterocyclic ring formed from $R^{43}$, $R^{44}$, and the nitrogen to which they are attached are substituted with 0-3 occurrences of alkyl, alkoxy, halo, OH, thioalkoxy, NH$_2$, NH(C$_1$-$C_6$ alkyl), N(C$_1$-$C_6$ alkyl) (C$_1$-$C_6$ alkyl), CF$_3$, OCF$_3$, phenyl optionally substituted with a halogen, —(C$_1$-$C_4$ alkyl)-N(H or $C_1$-$C_4$ alkyl)-phenyl, $C_1$-$C_4$ hydroxyalkyl, arylalkoxy, arylalkyl, arylalkanoyl, C(O)NH$_2$, C(O)NH(C$_1$-$C_6$ alkyl), C(O)N(C$_1$-$C_6$ alkyl) (C$_1$-$C_6$ alkyl), heterocycloalkylalkyl, $C_1$-$C_6$ alkoxycarbonyl, $C_2$-$C_6$ alkanoyl, heteroaryl, or —SO$_2$(C$_1$-$C_6$ alkyl); x is 0, 1, or 2; $R^{25}$ is $C_1$-$C_6$ alkyl, OH, NR$^{26}$R$^{27}$; $R^{26}$ and $R^{27}$ are independently hydrogen, $C_1$-$C_6$ alkyl, phenyl($C_1$-$C_4$ alkyl), aryl, or heteroaryl; or $R^{26}$, $R^{27}$ and the nitrogen to which they are attached form a heterocycloalkyl ring;

$R^{36}$ is heteroaryl($C_1$-$C_6$)alkyl where the cyclic portion is substituted 0-5 occurrences of halogen, $C_1$-$C_6$ alkyl, $C_1$-$C_6$ alkoxy, $C_1$-$C_4$ haloalkyl, $C_1$-$C_4$ haloalkoxy, aryl, arylalkyl, aryloxy, heteroaryl, —$SC_2$-aryl, —$S(O)_xR_{25}$, ($C_1$-$C_4$ alkyl)-$S(O)_xR_{25}$, CN, $C_1$-$C_6$ thioalkoxy, $C_1$-$C_6$ alkoxycarbonyl, —NR'R", —C(O)NR'R", heterocycloalkyl, where the above aryl groups are substituted with 0-4 occurrences of halogen, $C_1$-$C_6$ alkyl, $C_1$-$C_6$ alkoxy, $C_1$-$C_4$ haloalkyl, $C_1$-$C_4$ haloalkoxy, or CN; where the above heteroaryl and heterocycloalkyl groups are substituted with 0-3 occurrences of halogen, $CF_3$, ($C_1$-$C_4$)alkyl, $C_1$-$C_6$ thioalkoxy, OH, $C_1$-$C_4$ hydroxyalkyl, or $C_1$-$C_4$ alkoxy; or $R^{36}$ is heterocycloalkyl($C_1$-$C_6$ alkyl) where the cyclic portion is substituted with 0-3 occurrences of halogen, $C_1$-$C_6$ alkyl, $C_1$-$C_6$ alkoxy, $C_1$-$C_4$ haloalkyl, $C_1$-$C_4$ haloalkoxy, aryl, arylalkyl, aryloxy, heteroaryl, —$SO_2$-aryl, —$S(O)_xR^{25}$, ($C_1$-$C_4$ alkyl)-$S(O)_xR^{25}$, CN, $C_1$-$C_6$ thioalkoxy, $C_1$-$C_6$ alkoxycarbonyl, —NR'R", —C(O)NR'R", heterocycloalkyl;

$R^{37}$ is hydrogen, $C_1$-$C_6$ alkyl, or phenyl($C_1$-$C_4$)alkyl; $R^{38}$ is hydrogen, halogen, $C_1$-$C_6$ alkyl, $C_1$-$C_6$ alkoxy, $C_1$-$C_6$ haloalkyl, CN; $R^{39}$ is hydrogen, halogen, $C_1$-$C_6$ alkyl optionally substituted with —$CO_2$—($C_1$-$C_6$ alkyl), $C_1$-$C_6$ alkoxy, $C_1$-$C_6$ haloalkyl, $C_1$-$C_6$ haloalkoxy, CN, aryloxy, isocyanato, —$SO_2$($C_1$-$C_6$ alkyl), —NHR', —NR'R", $C_1$-$C_6$ alkanoyl, heteroaryl, aryl; or $R^{38}$ and $R^{39}$ and the carbons to which they are attached form a heterocycloalkyl ring which is substituted with 0-3 occurrences of $C_1$-$C_4$ alkyl, $C_1$-$C_4$ alkoxy, halogen, or $C_1$-$C_4$ alkanoyl where the alkanoyl group is substituted with 0-3 halogen atoms; $R^{40}$ is hydrogen, —$SO_2$NR'R", halogen; or $R^{39}$ and $R^{40}$ and the carbons to which they are attached form a benzo ring; or $R^{39}$ and $R^{40}$ and the carbons to which they are attached form a 1-oxa-2,3-diazacyclopentyl ring;

$R^{40}$ and $R^{41}$ are independently hydrogen or F; or $R^{41}$, $R^{41}$, and the carbons to which they are attached for a 1,2,5-oxadiazolyl ring; or $R^{40}$, $R^{41}$, and the carbons to which they are attached form a naphthyl ring.

In some embodiments, $R^{36}$ is 4-bromobenzyl. In some embodiments, $R^{37}$ is hydrogen. In some embodiments, k is 2. In some embodiments, each of $R^{38}$, $R^{40}$, $R^{41}$, and $R^{42}$ is independently hydrogen. In some embodiments, $R^{39}$ is chloro.

In some embodiments, the GSI is a compound described in U.S. Pat. No. 7,939,657. In one embodiment, the GSI is ELN-318463, i.e., HY-50882 or (R)—N-(4-bromobenzyl)-4-chloro-N-(2-oxoazepan-3-yl)benzenesulfonamide, or a pharmaceutically acceptable salt thereof. In some embodiments, the GSI is or a pharmaceutically acceptable salt thereof.

In some embodiments, the GSI is a compound of formula (VIII):

(VIII)

or a pharmaceutically acceptable salt thereof, where $R_1$ is —$CH_2CF_3$ or —$CH_2CH_2CF_3$; $R_2$ is —$CH_2CF_3$, —$CH_2CH_2CF_3$, or —$CH_2CH_2CH_2CF_3$; $R_3$ is hydrogen or —$CH_3$; each $R_a$ is independently F, Cl, —CN, —$OCH_3$, and/or —$NHCH_2CH_2OCH_3$; and z is 0, 1, or 2.

In some embodiments, $R^1$ is —$CH_2CH_2CF_3CH_2CH_2CF_3$. In some embodiments, $R_2$—$CH_2CH_2CF_3$. In some embodiments, $R_3$ is —$CH_3$. In some embodiments, z is 0.

In some embodiments, the GSI is a compound described in U.S. Pat. No. 8,629,136. In one embodiment, the GSI is BMS-906024, i.e., (2R,3S)—N-[(3S)-1-methyl-2-oxo-5-phenyl-2,3-dihydro-1H-1,4-benzodiazepin-3-yl]-2,3-bis(3,3,3-trifluoropropyl)succinamide, or a pharmaceutically acceptable salt thereof. In one embodiment, the GSI is or a pharmaceutically acceptable salt thereof.

In some embodiments, the GSI is a compound described in U.S. Pat. No. 8,629,136. In one embodiment, the GSI is LY3039478, crenigacestat or 4,4,4-trifluoro-N—((R)-1-(((S)-5-(2-hydroxyethyl)-6-oxo-6,7-dihydro-5H-benzo[d]pyrido[2,3-b]azepin-7-yl)amino)-1-oxopropan-2-yl)butanamide, or a pharmaceutically acceptable salt thereof. In some embodiments, the GSI is:

or a pharmaceutically acceptable salt thereof.

In some embodiments, the GSI is BMS-299897, i.e., 2-[(1R)-1-[[(4-chlorophenyl)sulfonyl](2,5-difluorophenyl) amino]ethyl-5-fluorobenzenebutanoic acid or a pharmaceutically acceptable salt thereof. In some embodiments, the GSI is or a pharmaceutically acceptable salt thereof.

In some embodiments, the GSI is LY-411575, i.e., LSN-411575, (S)-2-((S)-2-(3,5-difluorophenyl)-2-hydroxyacetamido)-N-((S)-5-methyl-6-oxo-6,7-dihydro-5H-dibenzo[b, d]azepin-7-yl)propanamide, or a pharmaceutically acceptable salt thereof. In some embodiments, the GSI is or a pharmaceutically acceptable salt thereof.

In some embodiments, the GSI is DAPT, N-[(3,5-difluorophenyl)acetyl]-L-alanyl-2-phenyl]glycine-1,1-dimethylethyl ester or a pharmaceutically acceptable salt thereof. In some embodiments, the GSI is or a pharmaceutically acceptable salt thereof.

In some embodiments, the GSI is a compound of the following formulae:

(VIII-a)

(VIII-b)

(VIII-c)

(VIII-d)

where, z1 is 0, 1 or 2; $X^1$ is $C(R^3)$ or N; $R^1$ is hydrogen, halogen, $-N_3$, $-CF_3$, $-CCl_3$, $-CBr_3$, $-Cl_3$, $-CN$, $-CHO$, $-OR^{1A}$, $-NR^{1A}R^{1B}$, $-COOR^{1A}$, $-C(O)NR^{1A}R^{1B}$, $-NO_2$, $-SR^{1A}$, $-S(O)_{n1}OR^{1A}$, $-S(O)_{n1}NR^{1A}R^{1B}$, $-NHNR^{1A}R^{1B}$, $-ONR^{1A}R^{1B}$, $-NHC(O)NHNR^{1A}R^{1B}$, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; $R^2$ is hydrogen, halogen, —N₃, —CF₃, —CCl₃, —CBr₃, —Cl₃, —CN, —CHO, —OR²ᴬ, —NR²ᴬR²ᴮ, —COOR²ᴬ, —C(O)NR²ᴬR²ᴮ, —NO₂, —SR²ᴬ, —S(O)ₙ₂R²ᴬ, —S(O)ₙ₂OR²ᴬ, —S(O)ₙ₂NR²ᴬR²ᴮ, —NHNR²ᴬR²ᴮ, —ONR²ᴬR²ᴮ, —NHC (O)NHNR²ᴬR²ᴮ, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; $R^3$ is hydrogen, halogen, —N₃, —CF₃, —CCl₃, —CBr₃, —CCl₃, —CN, —CHO, —OR³ᴬ, —NR³ᴬR³ᴮ, —COOR³ᴬ, —C(O)NR³ᴬR³ᴮ, —NO₂, —SR³ᴬ, —S(O)ₙ₃R³ᴬ, —S(O)ₙ₃OR³ᴬ, —S(O)ₙ₃ONR³ᴬR³ᴮ, —NHNR³ᴬR³ᴮ, —ONR³ᴬR³ᴮ, —NHC(O)NHNR³ᴬR³ᴮ, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; $R^4$ is hydrogen, halogen, —N₃, —CF₃, —CCl₃, —CBr₃, —CCl₃, —CN, —CHO, —OR", —NR⁴ᴬR⁴ᴮ, —COOR⁴ᴬ, —O(O)NR⁴ᴬR⁴ᴮ, 13 NO₂, —SR⁴ᴬ, —S(O)ₙ₄R⁴ᴬ, —S(O)ₙ₄OR⁴ᴬ, —S(O)ₙ₄NR⁴ᴬR⁴ᴮ, —NHNR⁴ᴬR⁴ᴮ, —ONR⁴ᴬR⁴ᴮ, —NHC (O)NHNR⁴ᴬR⁴ᴮ, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; $R^5$ is hydrogen, halogen, —N₃, —CF₃, —CCl₃, —CBr₃, —CCl₃, —CN, —CHO, —OR⁵ᴬ, —NR⁵ᴬR⁵ᴮ, —COOR⁵ᴬ, —C(O)NR⁵ᴬR⁵ᴮ, —NO₂, —SR⁵ᴬ, —S(O)ₙ₅R⁵ᴬ, —S(O)ₙ₅OR⁵ᴬ, —S(O)ₙ₅NR⁵ᴬR⁵ᴮ, —NHNR⁵ᴬR⁵ᴮ, —ONR⁵ᴬR⁵ᴮ, —NHC (O)NHNR⁵ᴬR⁵ᴮ, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl, where $R^4$ and $R^5$ are optionally joined together to form a substituted or unsubstituted heterocycloalkyl, or substituted or unsubstituted heteroaryl; $R^6$ is —CF₃, substituted or unsubstituted cyclopropyl, or substituted or unsubstituted cyclobutyl; $R^7$ is independently hydrogen, halogen, —N₃, —CF₃, —CCl₃, —CBr₃, —CCl₃, —CN, —CHO, —OR⁷ᴬ, —NR⁷ᴬR⁷ᴮ, —COOR⁷ᴬ, —C(O)NR⁷ᴬR⁷ᴮ, —NO₂, —SR⁷ᴬ, —S(O)ₙ₇R⁷ᴬ, —S(O)ₙ₇OR⁷ᴬ, —S(O)ₙ₇NR⁷ᴬR⁷ᴮ, —NHNR⁷ᴬR⁷ᴮ, —ONR⁷ᴬR⁷ᴮ, —NHC(O)NHNR⁷ᴬR⁷ᴮ, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; $R^{1A}$, $R^{1B}$, $R^{2A}$, $R^{2B}$, $R^{3A}$, $R^{3B}$, $R^{4A}$, $R^{4B}$, $R^{5A}$, $R^{5B}$, $R^{7A}$, —$R^{7B}$ are independently hydrogen, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; and n1, n2, n3, n4, n5 and n7 are independently 1 or 2.

In some embodiments, the GSI of formulae (VIII-a), (VIII-b), (VIII-c), or (VIII-d) is described in International Patent Publication No. WO 2014/165263 (e.g., in embodiments P1-P12). In some embodiments, the GSI of formulae (VIII-a), (VIII-b), (VIII-c), or (VIII-d) is selected from:

-continued or a pharmaceutically acceptable salt thereof.

In some embodiments, the GSI is a compound of formula (IX):

(XIV)

or a pharmaceutically acceptable salt thereof, where A is a 4 to 7 membered spirocyclic ring comprising at least one heteroatom selected from the group consisting of N, O, S, $S(O)_2$, $P(O)R^1$, and $N-S(O)_2-R^1$, where the spirocyclic ring is optionally substituted with 1 to 3 substituents selected from the group consisting of C1-3alkyl and $=O$; $R^1$ is C1-6alkyl optionally substituted with halo; each Lis independently selected from the group consisting of 1) C1-3alkyl optionally substituted with halo, and 2) halo; each $L^2$ is independently selected from the group consisting of 1) C1-3alkyl optionally substituted with halo, and 2) halo; and n is 0 to 3.

In some embodiments, the GSI is a compound described in U.S. Patent Publication No. US-2015-307533 (e.g., in the Table on pages 13-16). In some embodiments, the GSI is selected from:

-continued and or a pharmaceutically acceptable salt thereof.

In some embodiments, the GSI is a compound of formula (X):

(X)

or a pharmaceutically acceptable salt thereof, where $R^1$ is hydroxy or fluoro; $R^2$ is $C_1$-$C_4$ alkyl; $R^3$ is hydrogen or phenyl; $R^4$ is hydrogen, phenyl, or $C_1$-$C_4$ alkyl; $R^5$ is hydrogen or phenyl; provided that one of $R^3$, $R^4$, and $R^5$ is other than hydrogen and the other two are hydrogen.

In some embodiments, the GSI is a compound described in U.S. Pat. No. 8,188,069. In one embodiment, the GSI is or a pharmaceutically acceptable salt thereof.

In some embodiments, the GSI is a compound of formula (XI):

(XI)

or a pharmaceutically acceptable salt thereof, where: R$^1$ is 1) hydrogen, 2) (C1-C6)alkyl optionally substituted with 1 to 5 halogens or phenyl, where the phenyl is optionally substituted with 1 to 3 halogens, 3) phenyl optionally substituted with 1 to 3 (C1-C6)alkyls or 1 to 5 halogens, or 4) (C4-C6)cycloalkyl optionally substituted with 1 to 3 (C1-C6)alkyls or 1 to 5 halogens; R$^2$ is 1) hydrogen, 2) (C1-C6)alkyl optionally substituted with 1 to 5 halogens or phenyl, where the phenyl is optionally substituted with 1 to 3 halogens, or 3) phenyl optionally substituted with 1 to 3 halogens; R$^3$ is (C1-C6)alkyl, —OH or halogen;

X is —NR$^4$—, —O—, —S—, or —SO$_2$—; R$^4$ is hydrogen or (C1-C3)alkyl;

p is 1 to 3; m is 0 or 1; n is 0 to 3; and Ar$^2$—Ar$^1$ is selected from the group consisting of:

or a pharmaceutically acceptable salt thereof.

In some embodiments, the GSI is a compound described in U.S. Pat. No. 9,096,582 (e.g., in the Table on pages 13-17). In some embodiments, the GSI is:

or a pharmaceutically acceptable salt thereof.

In some embodiments, the GSI is a compound of formula (XII):

(XII)

or a pharmaceutically acceptable salt thereof, where or the pharmaceutically acceptable salts thereof, where: R$^1$, R$^2$, R$^3$, R$^8$, R$^9$, R$^{10}$, and W are independently selected; W is selected from the group consisting of: —S(O)—, and —S(O)$_2$—; R$^1$ is selected from the group consisting of H, alkyl-, alkenyl-, alkynyl-, aryl-, arylalkyl-, alkylaryl-, cycloalkyl-, cycloalkenyl, cycloalkylalkyl-, fused benzocycloalkyl (i.e., benzo-fusedcycloalkyl), fused benzoheterocycloalkyl (i.e., benzo-fusedheterocycloalkyl), fused heteroarylcycloalkyl (i.e., heteroarylfusedcycloalkyl), fused heteroarylheterocycloalkyl (i.e., heteroarylfused-heterocycloalkyl), heteroaryl-, heteroarylalkyl-, heterocyclyl-, heterocyclenyl, —and heterocyclylalkyl-; where each of the alkyl-, alkenyl- and alkynyl-, aryl-, arylalkyl-, alkylaryl-, cycloalkyl-, cycloalkenyl-, cycloalkylalkyl-, fused benzocycloalkyl, fused benzohetero-cycloalkyl, fused heteroarylcycloalkyl, fused heteroarylhet-erocycloalkyl, heteroaryl-, heteroarylalkyl-, heterocyclyl-, heterocyclenyl and heterocyclyalkyl-$R^1$ groups is optionally substituted with 1-5 independently selected $R^{21}$ groups; $R^2$ and $R^3$ are each independently selected from the group consisting of H, alkyl-, alkenyl-, alkynyl-, aryl-, arylalkyl-, alkylaryl-, cycloalkyl-, cycloalkenyl-, cycloalkylalkyl-, heteroaryl-, heteroarylalkyl-, heterocyclyl-, heterocyclenyl-, and heterocyclyalkyl-; where each of the alkyl-, alkenyl- and alkynyl-, aryl-, arylalkyl-, alkylaryl-, cycloalkyl-, cycloalkenyl, cycloalkylalkyl-, cycloalkenyl-, heteroaryl-, heteroarylalkyl-, heterocyclyl-, heterocyclenyl- and heterocyclyalkyl-$R^1$ groups is optionally substituted with 1-5 independently selected $R^{21}$ groups; or $R^2$ and $R^3$ taken together, along with the atoms to which they are bound, form a ring selected from the group consisting of: (a) a 5 to 6 membered heterocycloalkyl ring, the heterocycloalkyl ring optionally comprising, in addition to W and in addition to the N adjacent to W, at least one other heteroatom independently selected from the group consisting of: —O—, —S(O)—, —S(O)$_2$, and —C(O)—, and (b) a 5 to 6 membered heterocycloalkenyl ring, the heterocycloalkenyl ring optionally comprising, in addition to W and in addition to the N adjacent to W, at least one other heteroatom independently selected from the group consisting of: —O—, —S(O)—, —S(O)$_2$, and —C(O)—; where the ring is optionally substituted with 1-5 independently selected $R^{21}$ groups; or $R^2$ and $R^3$ taken together along with the atoms to which they are bound, and $R^1$ and $R^3$ are taken together along with the atoms to which they are bound, form the fused ring moiety:

where Ring A is a ring selected from the group consisting of:
(a) a 5 to 6 membered heterocycloalkyl ring, the heterocycloalkyl ring optionally comprising, in addition to W and in addition to the N adjacent to W, at least one other heteroatom independently selected from the group consisting of: —O—, —NR$^{14}$—, —S(O)—, —S(O)$_2$, and —C(O)—, and (b) a 5 to 6 membered heterocycloalkenyl ring, the heterocycloalkenyl ring optionally comprising, in addition to W and in addition to the N adjacent to W, at least one other heteroatom independently selected from the group consisting of: —O—, —NR$^{14}$—, —S(O)—, —S(O)$_2$, and —C(O)—, and where the fused ring moiety is optionally substituted with 1-5 independently selected $R^{21}$ groups; or $R^1$ and $R^3$ taken together with the atoms to which they are bound form a fused benzoheterocycloalkyl ring, and where the fused ring is optionally substituted with 1-5 independently selected $R^{21}$ groups, $R^8$ is selected from the group consisting of H, alkyl-, alkenyl-, alkynyl-, aryl-, arylalkyl-, alkylaryl-, cycloalkyl-, cycloalkenyl, cycloalkylalkyl-, heteroaryl-, heteroarylalkyl-, heterocyclyl-, heterocyclenyl- and heterocyclyalkyl-; where each of the $R^8$ alkyl-, alkenyl- and alkynyl-, aryl-, arylalkyl-, alkylaryl-, cycloalkyl-, cycloalkenyl, cycloalkylalkyl-, heteroaryl-, heteroarylalkyl-, heterocyclyl-, heterocyclenyl- and heterocyclyalkyl- is optionally substituted with 1-3 independently selected $R^{21}$ groups; $R^9$ is selected from the group consisting of: alkyl-, alkenyl-, alkynyl-, aryl-, arylalkyl-, alkylaryl-, cycloalkyl-, cycloalkenyl, cycloalkylalkyl, heteroaryl-, heteroarylalkyl-, heterocyclyl-, heterocyclenyl-, and heterocyclyalkyl-, where each of the $R^9$ alkyl-, alkenyl- and alkynyl-, aryl-, arylalkyl-, alkylaryl-, cycloalkyl-, cycloalkenyl, cycloalkyl alkyl-, heteroaryl-, heteroarylalkyl-, heterocyclyl-, heterocyclenyl-, heterocyclyalkyl- and heterocyclyalkyl- is optionally substituted with 1-3 independently selected $R^{21}$ groups;
$R^{10}$ is selected from the group consisting of: a bond, alkyl-, alkenyl-, alkynyl-, aryl-, arylalkyl-, alkylaryl-, cycloalkyl-, cycloalkenyl, cycloalkylalkyl-, heteroaryl-, heteroarylalkyl-, heterocyclyl-, heterocyclenyl-, heterocyclyalkyl-, heterocyclyalkenyl-, where X is selected from the group consisting of: O, —N(R$^{14}$)— or —S—; and
where each of the $R^{10}$ moieties is optionally substituted with 1-3 independently selected $R^{21}$ groups; $R^{14}$ is selected from the group consisting of H, alkyl, alkenyl, alkynyl, cycloalkyl, cycloalkylalkyl, cycloalkenyl, heterocyclyl, heterocyclenyl, heterocyclylalkyl, heterocyclyalkenyl-, aryl, arylalkyl, heteroaryl, heteroarylalkyl, —ON, —C(O)R$^{15}$, —C(O)OR$^{15}$, —C(O)N(R$^{15}$)(R$^{16}$), —S(O)N(R$^{15}$)(R$^{16}$), —S(O)$_2$N(R$^{15}$)(R$^{16}$), —C(=NOR$^{15}$)R$^{16}$, and —P(O)(OR$^{15}$)(OR$^{16}$); $R^{15}$, $R^{16}$ and $R^{17}$ are independently selected from the group consisting of H, alkyl, alkenyl, alkynyl, cycloalkyl, cycloalkylalkyl, heterocyclyl, heterocyclylalkyl, aryl, arylalkyl, heteroaryl, heteroarylalkyl, arylcycloalkyl, arylheterocyclyl, (R$^{18}$)$_n$-alkyl, (R$^{18}$)$_n$-cycloalkyl, (R$^{18}$)$_n$-cycloalkylalkyl, (R$^{18}$)$_n$-heterocyclyl, (R$^{18}$)$_n$-heterocyclylalkyl, (R$^{18}$)$_n$-aryl, (R$^{18}$)$_n$-arylalkyl, (R$^{18}$)$_n$-heteroaryl and (R$^{18}$)$_n$-heteroarylalkyl; each R$^{18}$ is independently selected from the group consisting of alkyl, alkenyl, alkynyl, aryl, arylalkyl, arylalkenyl, arylalkynyl, —NO$_2$, halo, heteroaryl, HO-alkyoxyalkyl, —CF$_3$, —CN, alkyl-CN, —C(O)R$^{19}$, —C(O)OH, —C(O)OR$^{19}$, —C(O)NHR$^{20}$, —C(O)NH$_2$, —C(O)NH$_2$—C(O)N(alkyl)$_2$, —C(O)N(alkyl)(aryl), —C(O)N(alkyl)(heteroaryl), —SR$^{19}$, —S(O)$_2$R$^{20}$, —S(O)NH$_2$, —S(O)NH(alkyl), —S(O)N(alkyl)(alkyl), —S(O)NH (aryl), —S(O)$_2$NH$_2$, —S(O)$_2$NHR$^{19}$, —S(O)$_2$NH(heterocyclyl), —S(O)₂N(alkyl)₂, —S(O)₂N(alkyl)(aryl), —OCF₃, —OH, —OR²⁰, —O-heterocyclyl, —O-cycloalkylalkyl, —O-heterocyclylalkyl, —NH₂, —NHR²⁰, —N(alkyl)₂, —N(arylalkyl)₂, —N(arylalkyl)-(heteroarylalkyl), —NHC(O)R²⁰, —NHC(O) NH₂, —NHC(O)NH(alkyl), —NHC(O)N(alkyl)(alkyl), —N(alkyl)C(O)NH(alkyl), —N(alkyl)C(O)N (alkyl)(alkyl), —NHS(O)₂R²⁰, —NHS(O)₂NH(alkyl), —NHS(O)₂N(alkyl)(alkyl), —N(alkyl)S(O)₂NH(alkyl) and —N(alkyl)S(O)₂N(alkyl)(alkyl); or two R¹⁸ moieties on adjacent carbons can be linked together to form a R¹⁹ is selected from the group consisting of: alkyl, cycloalkyl, aryl, arylalkyl and heteroarylalkyl; R²⁰ is selected from the group consisting of: alkyl, cycloalkyl, aryl, halo substituted aryl, arylalkyl, heteroaryl and heteroarylalkyl; each R²¹ is independently selected from the group consisting of: alkyl, alkenyl, alkynyl, cycloalkyl, cycloalkylalkyl, cycloalkenyl, heterocycloalkyl, heterocycloalkylalkyl, aryl, arylalkyl, heteroaryl, heteroarylalkyl, halo, —ON, —OR¹⁵, —C(O) R¹⁵, —C(O)OR¹⁵, —C(O)N(R¹⁵)(R¹⁶), —SR¹⁵, —S(O)N(R¹⁶)(R¹⁶), —CH(R¹⁵)(R¹⁶), —S(O)₂N(R¹⁶) (R¹⁶), —C(=NOR¹⁶)R¹⁶, —P(O)(OR¹⁵)(OR¹⁶), —N(R¹⁵)(R¹⁶), -alkyl-N(R¹⁵)(R¹⁶), —N(R¹⁵)C(O) R¹⁶, —CH₂—N(R¹⁵)C(O)R¹⁶, —CH₂—N(R¹⁵)C(O)N (R¹⁶)(R¹⁷), —OH₂—R¹⁵; —CH₂N(R¹⁵)(R¹⁶), —N(R¹⁵)S(O)R¹⁶, —N(R¹⁵)S(O)₂R¹⁶, —CH₂—N (R¹⁵)S(O)₂R¹⁶, —N(R¹⁵)S(O)₂N(R¹⁶)(R¹⁷), —N(R¹⁵) S(O)N(R¹⁶)(R¹⁷), —N(R¹⁵)C(O)N(R¹⁶)(R¹⁷), —CH₂—N(R¹⁵)C(O)N(R¹⁶)(R¹⁷), —N(R¹⁵)C(O) OR¹⁶, —CH₂—N(R¹⁵)C(O)OR¹⁶, —S(O)R¹⁵, =NOR¹⁵, —N₃, —NO₂ and —S(O)₂R¹⁵; where each of the alkyl, alkenyl, alkynyl, cycloalkyl, cycloalkylalkyl, cycloalkenyl, heterocycloalkyl, heterocycloalkylalkyl, aryl, arylalkyl, heteroaryl, and heteroarylalkyl R²¹ groups is optionally substituted with 1 to 5 independently selected R²² groups; and each R²² group is independently selected from the group consisting of alkyl, cycloalkyl, cycloalkenyl, heterocycloalkyl, aryl, heteroaryl, halo, —CF₃, —CN, —OR¹⁵, —C(O)R¹⁵, —C(O)OR¹⁵, -alkyl-C(O)OR¹⁵, C(O)N(R¹⁵)(R¹⁶), —SR¹⁵, —S(O)N(R¹⁵)(R¹⁶), —S(O)₂N(R¹⁵)(R¹⁶), —C(=NOR¹⁵)R¹⁶, —P(O)(OR¹⁵)(OR¹⁶), —N(R¹⁵) (R¹⁶), -alkyl-N(R¹⁵)(R¹⁶), —N(R¹⁵)C(O)R¹⁶, —CH₂—N(R¹⁵)C(O)R¹⁶, —N(R¹⁵)S(O)R¹⁶, —N(R¹⁵)S(O)₂R¹⁶, —CH₂—N(R¹⁵)S(O)₂R¹⁶, —N(R¹⁵)S(O)₂N(R¹⁶)(R¹⁷), —N(R¹⁵)S(O)N(R¹⁶) (R¹⁷), —N(R¹⁵)C(O)N(R¹⁶)(R¹⁷), —CH₂—N(R¹⁵)C (O)N(R¹⁶)(R¹⁷); —N(R¹⁵)C(O)OR¹⁶, —CH₂—N(R¹⁵) C(O)OR¹⁶, —N₃, =NOR¹⁵, —NO₂, —S(O)R¹⁵ and —S(O)₂R¹⁵.

In some embodiments, the GSI is a compound described in U.S. Patent Publication No. US-2011-0257163 (e.g., in paragraphs [0506] to [0553]). In some embodiments, the compound of formula (XII) is a pharmaceutically acceptable ester. In some embodiments, the compound of formula (XII) is selected from:

-continued and pharmaceutically acceptable salts thereof.

In some embodiments, the GSI is a compound of formula (XIII):

(XIII)

or a pharmaceutically acceptable salt thereof, where the A-ring is aryl, cycloalkyl, heteroaryl or heterocycloalkyl, where each ring is optionally substituted at a substitutable position with halogen, $C_1$-$C_6$ alkyl, $C_2$-$C_6$ alkenyl, $C_2$-$C_6$ alkynyl, $C_1$-$C_6$ alkoxy, haloalkyl, haloalkoxy, hydroxyl, hydroxyalkyl, CN, phenoxy, —S(O)$_{0-2}$—($C_1$-$C_6$ alkyl), —NR$_{10}$R$_{11}$, $C_1$-$C_6$ alkanoyl, $C_0$-$C_3$alkylCO$_2$R', heteroaryl, heterocycloalkyl, aryl, aralkyl, or —SO$_2$NR$_{10}$R$_{11}$; R$_1$ and R$_2$ combine to form a [3.3.1] or a [3.2.1] ring system, where 0 or 1 of the carbons in the ring system is optionally replaced with an —O—, —S(O)$_x$—, or —NR$_{15}$— group; and where the [3.3.1] or [3.2.1] ring system is optionally substituted with 1, 2, 3, or 4 groups that are independently oxo, halogen, $C_1$-$C_6$ alkyl, —O($C_1$-$C_2$ alkyl)O—, —S($C_1$-$C_2$ alkyl)S—, $C_2$-$C_6$ alkenyl, $C_1$-$C_6$ haloalkyl, $C_2$-$C_6$ alkynyl, hydroxy, hydroxyalkyl, $C_1$-$C_6$ alkoxy, haloalkoxy, —C(O)OR—, —(C$_1$-

C$_4$alkyl)-C(O)OR$_{16}$, —CONR$_{10}$R$_{11}$, —OC(O) NR$_{10}$R", —NR'C(O)OR", —NR'S(O)$_2$R", —OS(O)$_2$R', —NR'COR", CN, =N—NR$_{12}$, or =N—O—R$_{13}$; where x is 0, 1, or 2; R$_{10}$ and R$_{11}$ at each occurrence are independently hydrogen or $C_1$-$C_6$ alkyl, where the alkyl is optionally substituted with an aryl, where the aryl is optionally substituted with 1 to 5 groups that are independently halogen, hydroxyl, alkyl, alkoxy, haloalkyl, haloalkoxy, CN or NO$_2$; or R$_{10}$ and R$_{11}$ together can form a 3-8 membered ring optionally including an additional heteroatom such as N, O or S; R$_{12}$ is hydrogen, $C_1$-$C_6$ alkyl or —SO$_2$-aryl, where the aryl is optionally substituted with 1 to 5 groups that are independently halogen, hydroxyl, alkyl, alkoxy, haloalkyl, haloalkoxy, CN or NO$_2$; R$_{13}$ is hydrogen or $C_1$-$C_6$ alkyl optionally substituted with aryl, hydroxyl, or halogen, where the aryl is optionally substituted with 1 to 5 groups that are independently halogen, hydroxyl, alkyl, alkoxy, haloalkyl, haloalkoxy, CN or NO$_2$;

R$_{15}$ is hydrogen, aryl, heteroaryl, —SO$_2$R', —C(O)R', —C(O)OR', or $C_1$-$C_6$ alkyl optionally substituted with aryl, hydroxyl, or halogen, where the aryl groups are optionally substituted with 1 to 5 groups that are independently halogen, hydroxyl, alkyl, alkoxy, haloalkyl, haloalkoxy, CN or NO$_2$; and R' and R" are independently hydrogen, $C_1$-$C_6$ alkyl, haloalkyl, $C_2$-$C_6$ alkenyl or phenyl optionally substituted with 1 to 5 groups that are independently halogen, $C_1$-$C_6$ alkyl, —C(O) OR', $C_1$-$C_6$ alkoxy, haloalkyl, haloalkoxy, hydroxyl, CN, phenoxy, —SO$_2$—($C_1$-$C_6$alkyl), —NR$_{10}$R$_{11}$, $C_1$-$C_6$ alkanoyl, pyridyl, phenyl, NO$_2$, or —SO$_2$NR$_{10}$R$_{11}$.

In some embodiments, the GSI is a compound described in U.S. Patent Publication No. US-2011-178199 (e.g., in paragraphs [0798] to [0799] and Tables 1-4). In some embodiments, the compound of formula (XIII) comprises a bridged n-bicyclic sulfonamide or a pharmaceutically acceptable salt thereof. In some embodiments, the GSI is selected from:

413

414

-continued and pharmaceutically acceptable salts thereof.

In some embodiments, the GSI is a compound of formula (XIV):

(XIV)

or a pharmaceutically acceptable salt thereof, where R is selected from the group consisting of: (1) -pyridinyl, (2) -pyrazolinyl, (3) -1,2,4-oxadiazolyl, (4) —(C1-C2) alkyl-pyridinyl, (5) —(C1-C2)alkyl-pyrazolinyl, and (6) —(C1-C2)alkyl-1,2,4-oxadiazolyl, where the pyridinyl, pyrazolinyl, and –1,2,4-oxadiazolyl, is unsubstituted or substituted with one $L^1$ group; $R^1$ is independently selected from the group consisting halogen, (C1-C6)alkyl, —CN, —CF$_3$, —O-(C1-C6)alkyl, —O-(halo(C1-C6)alkyl), —C(O)—O—(C1-C6)-OH-substituted (C1-C4)alkyl, halo(C1-C6)alkyl, —(C1-C4)alkoxy-OH, —(C1-C4)alkoxy(C1-C4)alkoxy and —S(O)$_2$(C1-C6)alkyl; n is 0, 1, 2, or 3; Ar is selected from the group consisting of phenyl optionally substituted with 1 or 2 $L^2$ groups, and pyridyl optionally substituted with 1 or 2 $L^2$ groups;

$L^1$ is independently selected from the group consisting of —OCH$_3$, —NH$_2$, =O, and (C1-C5)alkyl; and $L^2$ is independently selected from the group consisting of halogen, (C1-C6)alkyl, —CN, —CF$_3$, —O—(C1-C6) alkyl, —O-(halo(C1-C6)alkyl), —C(O)—O—(C1-C6) alkyl, —OH-substituted(C1-C6)alkyl, halo(C1-C6)alkyl, —OH-substituted (C1-C4)alkoxy, —(C1-C4) alkoxy(C1-C4)alkoxy and —S(O)$_2$(C1-C6)alkyl.

In some embodiments, the GSI is a compound described in U.S. Pat. No. 9,226,927 (e.g., compound 4, 8a, 8b, 11, 14, 25a, 25b, 25c, 25d, 25e, 25f, 25g, 25h, 27a, or 27b). In some embodiments, the compound of formula (XIV) comprises a bridged n-bicyclic sulfonamide or a pharmaceutically acceptable salt thereof. In some embodiments, the GSI is selected from:

-continued and pharmaceutically acceptable salts thereof.

In some embodiments, the GSI is an antibody molecule that reduces the expression and/or function of gamma secretase. In some embodiments, the GSI is an antibody molecule targeting a subunit of gamma secretase. In some embodiments, the GSI is chosen from an anti-presenilin antibody molecule, an anti-nicastrin antibody molecule, an anti-APH-1 antibody molecule, or an anti-PEN-2 antibody molecule.

Exemplary antibody molecules that target a subunit of gamma secretase (e.g., e.g., presenilin, nicastrin, APH-1, or PEN-2) are described in U.S. Pat. Nos. 8,394,376, 8,637, 274, and 5,942,400.

In one aspect, the disclosure provides a method for treating subjects having a B cell condition or disorder, comprising administering to the subject an effective amount of: (i) a MBM, and (ii) a gamma secretase modulator (e.g., a GSI). Exemplary B cell conditions or disorders that can be treated with the combination of a MBM and a gamma secretase modulator include multiple myeloma, Waldenstrom's macroglobulinemia, chronic lymphocytic leukemia, B cell non-Hodgkin's lymphoma, plasmacytoma, Hodgkins' lymphoma, follicular lymphomas, small non-cleaved cell lymphomas, endemic Burkitt's lymphoma, sporadic Burkitt's lymphoma, marginal zone lymphoma, extranodal mucosa-associated lymphoid tissue lymphoma, nodal monocytoid B cell lymphoma, splenic lymphoma, mantle cell lymphoma, large cell lymphoma, diffuse mixed cell lymphoma, immunoblastic lymphoma, primary mediastinal B cell lymphoma, pulmonary B cell angiocentric lymphoma, small lymphocytic lymphoma, B cell proliferations of uncertain malignant potential, lymphomatoid granulomatosis, post-transplant lymphoproliferative disorder, an immunoregulatory disorder, rheumatoid arthritis, myasthenia gravis, idiopathic thrombocytopenia purpura, anti-phospholipid syndrome, Chagas' disease, Grave's disease, Wegener's granulomatosis, poly-arteritis nodosa, Sjogren's syndrome, pemphigus vulgaris, scleroderma, multiple sclerosis, antiphospholipid syndrome, ANCA associated vasculitis, Goodpasture's disease, Kawasaki disease, autoimmune hemolytic anemia, rapidly progressive glomerulonephritis, heavychain disease, primary or immunocyte-associated amyloidosis, and monoclonal gammopathy of undetermined significance.

In some embodiments, the gamma secretase modulator is a gamma secretase modulator described in WO 2017/019496. In some embodiments, the gamma secretase modulator is γ-secretase inhibitor I (GSI I) Z-Leu-Leu-Norleucine; γ-secretase inhibitor II (GSI II); γ-secretase inhibitor III (GSI III), N-Benzyloxycarbonyl-Leu-leucinal, N-(2-Naphthoyl)-Val-phenylalaninal; γ-secretase inhibitor IV (GSI IV); y-secretase inhibitor V (GSI V), N-Benzyloxycarbonyl-Leu-phenylalaninal; γ-secretase inhibitor VI (GSI VI), 1-(S)-endo-N-(1,3,3)-Trimethylbicyclo[2.2.1]hept-2-yl)-4-fluorophenyl Sulfonamide; γ-secretase inhibitor VII (GSI VII), Menthyloxycarbonyl-LL-CHO; γ-secretase inhibitor IX (GSI IX), (DAPT), N—[N-(3,5-Difluorophenacetyl-L-alanyl)]-S-phenylglycine t-Butyl Ester; γ-secretase inhibitor X (GSI X), {1 S-Benzyl-4R-[1-(1S-carbamoyl-2-phenethylcarbamoyl)-1S-3-methylbutylcarb-amoyl]-2R-hydroxy-5-phenylpentyl}carbamic Acid tert-butyl Ester; γ-secretase inhibitor XI (GSI XI), 7-Amino-4-chloro-3-methoxyisocoumarin; γ-secretase inhibitor XII (GSI XII), Z-Ile-Leu-CHO; γ-secretase inhibitor XIII (GSI XIII), Z-Tyr-Ile-Leu-CHO; γ-secretase inhibitor XIV (GSI XIV), Z-Cys(t-Bu)-Ile-Leu-CHO; γ-secretase inhibitor XVI (GSI XVI), N—[N-3,5-Difluorophenacetyl]-L-alanyl-S-phenylglycine Methyl Ester; γ-secretase inhibitor XVII (GSI XVII); γ-secretase inhibitor XIX (GSI XIX), benzo[e][I,4]diazepin-3-yl)-butyramide; γ-secretase inhibitor XX (GSI XX), (S,S)-2-[2-(3,5-Difluorophenyl)acetylamino]-N-(5-methyl-6-oxo-6,7-dihydro-5H-dibenzo[b,d]azepin-7-yl)propionamide; γ-secretase inhibitor XXI (GSI XXI), (S,S)-2-[2-(3,5-Difluorophenyl)-acetylamino]-N-(1-methyl-2-oxo-5-phenyl-2-,3-dihydro-1H-benzo[e][1,4]diazepin-3-yl)-propionamide; Gamma40 secretase inhibitor I, N-trans-3,5-Dimethoxycinnamoyl-Ile-leucinal; Gamma40 secretase inhibitor II, N-tert-Butyloxycarbonyl-Gly-Val-Valinal; Isovaleryl-V V-Sta-A-Sta-OCH₃; MK-0752 (Merck); MRK-003 (Merck); semagacestat/LY450139 (Eli Lilly);

RO4929097; PF-03084014; BMS-708163; MPC-7869 (γ-secretase modifier), YO-01027 (Dibenzazepine); LY411575 (Eli Lilly and Co.); L-685458 (Sigma-Aldrich); BMS-289948 (4-chloro-N-(2,5-difluorophenyl)-N-((IR)-{4-fluoro-2-[3-(1H-imidazol-1-yl)propyl]phenyl}ethyl)benzenesulfonamide hydrochloride); or BMS-299897 (4-[2-((IR)-1-{[(4-chlorophenyl)sulfonyl]-2,5-difluoroanilino}ethyl)-5-fluorophenyl]butanoic acid) (Bristol Myers Squibb).

In some embodiments, a MBM can be used in combination with a member of the thalidomide class of compounds. Members of the thalidomide class of compounds include, but are not limited to, lenalidomide (CC-5013), pomalidomide (CC-4047 or ACTIMID), thalidomide, and salts and derivatives thereof. In some embodiments, the compound can be a mixture of one, two, three, or more members of the thalidomide class of compounds. Thalidomide analogs and immunomodulatory properties of thalidomide analogs are described in Bodera and Stankiewicz, Recent Pat Endocr Metab Immune Drug Discov. 2011 September; 5(3):192-6. The structural complex of thalidomide analogs and the E3 ubiquitin is described in Gandhi et al., Br J Haematol. 2014 March; 164(6):811-21. The modulation of the E3 ubiquitin ligase by thalidomide analogs is described in Fischer et al., Nature. 2014 Aug. 7; 512(7512):49-53.

In some embodiments, the member of the thalidomide class of compounds comprises a compound of Formula (I):

(I)

or a pharmaceutically acceptable salt, ester, hydrate, solvate, or tautomer thereof, where:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O) $R^A$, —C(O)OR$^B$, —OR$^B$, —N(R$^C$)(R$^D$), —C(O)N(R$^C$) (R$^D$), —N(R$^C$)C(O)R$^A$, —S(O)$_x$R$^E$, —S(O)$_x$N(R$^C$) (R$^D$), or —N(R$^C$)S(O)$_x$R$^E$, where each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)R$^A$, —C(O)OR$^B$, —OR$^B$, —N(R$^C$)(R$^D$), —C(O)N(R$^C$)(R$^D$), —N(R$^C$)C(O)R$^A$, —S(O)$_x$R$^E$, —S(O)$_x$N(R$^C$)(R$^D$), —N (R$^C$)S(O)$_x$R$^E$, carbocyclyl, heterocyclyl, aryl, or heteroaryl, where each alkyl, alkenyl, alkynyl, heteroalkyl, carbocyclyl, heterocyclyl, aryl, and heteroaryl is independently and optionally substituted with one or more $R^7$;

each of R$^A$, R$^B$, R$^C$, R$^D$, and R$^E$ is independently hydrogen or $C_1$-$C_6$ alkyl;

each $R^6$ is independently $C_1$-$C_6$ alkyl, oxo, cyano, —OR$^B$, —N(R$^C$)(R$^D$), —C(O)N(R$^C$)(R$^D$), —N(R$^C$)C(O)R$^A$, aryl, or heteroaryl, where each aryl and heteroaryl is independently and optionally substituted with one or more $R^8$;

each $R^7$ is independently halo, oxo, cyano, —OR$^B$, —N(R$^C$)(R$^D$), —C(O)N(R$^C$)(R$^D$), or —N(R$^C$)C(O)R$^A$;

each $R^8$ is independently $C_1$-$C_6$ alkyl, cyano, —OR$^B$, —N(R$^C$)(R$^D$), —C(O)N(R$^C$)(R$^D$), or —N(R$^C$)C(O)R$^A$;

n is 0, 1, 2, 3 or 4; and x is 0, 1, or 2.

In some embodiments, X is O.

In some embodiments, $R^1$ is heterocyclyl. In some embodiments, $R^1$ is a 6-membered heterocyclyl or a 5-membered heterocyclyl. In some embodiments, $R^1$ is a nitrogen-containing heterocyclyl. In some embodiments, $R^1$ is piperidinyl (e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, $R^3$ is $C_1$-$C_6$ heteroalkyl, —N(R$^C$) (R$^D$) or —N(R$^C$)C(O)R$^A$. In some embodiments, $R^3$ is $C_1$-$C_6$ heteroalkyl (e.g., CH$_2$NHC(O)CH$_2$-phenyl-t-butyl), —N(R$^C$)(R$^D$) (e.g., NH$_2$), or —N(R$^C$)C(O)R$^A$ (e.g., NHC (O)CH$_3$).

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is —N(R$^C$)(R$^D$) (e.g., —NH$_2$). In an embodiment, the compound comprises lenalidomide, e.g., 3-(4-amino-1-oxoisoindolin-2-yl)piperidine-2,6-dione, or a pharmaceutically acceptable salt thereof. In an embodiment, the compound is lenalidomide, e.g., according to the following formula:

In an embodiment, X is O. In an embodiment, $R^1$ is heterocyclyl (e.g., piperidinyl-2,6-dionyl). In some embodiments, $R^{2a}$ and $R^{2b}$ together with the carbon to which they are attached form a carbonyl group. In an embodiment, n is 1. In an embodiment, $R^3$ is —N(R$^C$)(R$^D$) (e.g., —NH$_2$). In an embodiment, the compound comprises pomalidomide, e.g., 4-amino-2-(2,6-dioxopiperidin-3-yl)isoindoline-1,3-dione, or a pharmaceutically acceptable salt thereof. In an embodiment, the compound is pomalidomide, e.g., according to the following formula:

In an embodiment, X is O. In an embodiment, $R^1$ is heterocyclyl (e.g., piperidinyl-2,6-dionyl). In an embodiment, $R^{2a}$ and $R^{2b}$ together with the carbon to which they are attached form a carbonyl group. In an embodiment, n is 0. In an embodiment, the compound comprises thalidomide, e.g., 2-(2,6-dioxopiperidin-3-yl)isoindoline-1,3-dione, or a pharmaceutically acceptable salt thereof. In an embodiment, the product is thalidomide, e.g., according to the following formula:

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is $C_1$-$C_6$ heteroalkyl (e.g., $CH_2NHC(O)CH_2$-phenyl-t-butyl) In an embodiment, the compound comprises 2-(4-(tert-butyl)phenyl)-N-((2-(2,6-dioxopiperidin-3-yl)-1-oxoisoindolin-5-yl)methyl)acetamide, or a pharmaceutically acceptable salt thereof. In an embodiment, the compound has the structure as shown in the following formula:

In some embodiments, the compound is a compound of Formula (I-a):

(I-a)

or a pharmaceutically acceptable salt, ester, hydrate, or tautomer thereof, where:

Ring A is carbocyclyl, heterocyclyl, aryl, or heteroaryl, each of which optionally substituted with one or more $R^4$;

M is absent, $C_1$-$C_6$ alkyl, $C_2$-$C_6$ alkenyl, $C_2$-$C_6$ alkynyl, or $C_1$-$C_6$ heteroalkyl, where each alkyl, alkenyl, alkynyl, and heteroalkyl is optionally substituted with one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;

$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)OR$^B$, —OR$^B$, —N(R$^C$)(R$^D$), —C(O)N(R$^C$)(R$^D$), —N(R$^C$)C(O)R$^A$, —S(O)$_x$R$^E$, —S(O)$_x$N(R$^C$)(R$^D$), or —N(R$^C$)S(O)$_x$R$^E$, where each alkyl, alkenyl, alkynyl, and heteroalkyl is optionally substituted with one or more $R^6$;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)R$^A$, —C(O)OR$^B$, —OR$^B$, —N(R$^C$)(R$^D$), —C(O)N(R$^C$)(R$^D$), —N(R$^C$)C(O)R$^A$, —S(O)$_x$R$^E$, —S(O)$_x$N(R$^C$)(R$^D$), or —N (R$^C$)S(O)$_x$R$^E$, where each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)R$^A$, —C(O)OR$^B$, —OR$^B$, —N(R$^C$)(R$^D$), —C(O)N(R$^C$)(R$^D$), —N(R$^C$)C(O)R$^A$, S(O)$_x$R$^E$, —S(O)$_x$N(R$^C$)(R$^D$), —N (R$^C$)S(O)$_x$R$^E$, carbocyclyl, heterocyclyl, aryl, or heteroaryl, where each alkyl, alkenyl, alkynyl, carbocyclyl, heterocyclyl, aryl, or heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —OR$^B$, —N(R$^C$)(R$^D$), —C(O)N(R$^C$)(R$^D$), —N(R$^C$)C(O)R$^A$, aryl, or heteroaryl, where each aryl or heteroaryl is independently and optionally substituted with one or more $R^8$;

each $R^7$ is independently halo, oxo, cyano, —OR$^B$, —N(R$^C$)(R$^D$), —C(O)N(R$^C$)(R$^D$), or —N(R$^C$)C(O)R$^A$;

each $R^8$ is independently $C_1$-$C_6$ alkyl, cyano, —OR$^B$, —N(R$^C$)(R$^D$), —C(O)N(R$^C$)(R$^D$), or —N(R$^C$)C(O)R$^A$;

n is 0, 1, 2, or 3;

is 0, 1, 2, 3, 4, or 5; and x is 0, 1, or 2.

In some embodiments, X is O.

In some embodiments, M is absent.

In some embodiments, Ring A is heterocyclyl. In some embodiments, Ring A is heterocyclyl, e.g., a 6-membered heterocyclyl or a 5-membered heterocyclyl. In some embodiments, Ring A is a nitrogen-containing heterocyclyl. In some embodiments, Ring A is piperidinyl (e.g., piperidine-2,6-dionyl).

In some embodiments, M is absent and Ring A is heterocyclyl (e.g., piperidinyl, e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, $R^{3a}$ is hydrogen, —N(R$^C$)(R$^D$) or —N(R$^C$)C(O)R$^A$. In some embodiments, $R^{3a}$ is hydrogen. In some embodiments, $R^{3a}$ is —N(R$^C$)(R$^D$) (e.g., —NH$_2$). In some embodiments, $R^{3a}$ is —N(R$^C$)C(O)R$^A$ (e.g, NHC(O) CH$_3$).

In some embodiments, $R^3$ is $C_1$-$C_6$ heteroalkyl (e.g., $CH_2NHC(O)CH_2$-phenyl-t-butyl). In some embodiments, n is 0 or 1. In some embodiments, n is 0. In some embodiments, n is 1.

The compound can comprise one or more chiral centers or exist as one or more stereoisomers. In some embodiments, the compound comprises a single chiral center and is a mixture of stereoisomers, e.g., an R stereoisomer and an S stereoisomer. In some embodiments, the mixture comprises a ratio of R stereoisomers to S stereoisomers, for example, about a 1:1 ratio of R stereoisomers to S stereoisomers (i.e., a racemic mixture). In some embodiments, the mixture comprises a ratio of R stereoisomers to S stereoisomers of about 51:49, about 52:48, about 53:47, about 54:46, about 55:45, about 60:40, about 65:35, about 70:30, about 75:25, about 80:20, about 85:15, about 90:10, about 95:5, or about 99:1. In some embodiments, the mixture comprises a ratio of S stereoisomers to R stereoisomers of about 51:49, about 52:48, about 53:47, about 54:46, about 55:45, about 60:40, about 65:35, about 70:30, about 75:25, about 80:20, about 85:15, about 90:10, about 95:5, or about 99:1. In some embodiments, the compound is a single stereoisomer of Formula (I) or Formula (I-a), e.g., a single R stereoisomer or a single S stereoisomer.

In some embodiments, the MBM is administered in combination with a kinase inhibitor. In one embodiment, the kinase inhibitor is a PI3-kinase inhibitor, e.g., CLR457, BGT226, or BYL719. In one embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d] pyrimidine. The MNK inhibitor can be, e.g., a MNK1a, MNK1b, MNK2a and/or MNK2b inhibitor. In one embodiment, the kinase inhibitor is a dual PI3K/mTOR inhibitor described herein, such as, e.g., PF-04695102. In one embodiment, the kinase inhibitor is a DGK inhibitor, e.g., a DGK inhibitor described herein, such as, e.g., DGKinh1 (D5919) or DGKinh2 (D5794).

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In an embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In some embodiments, a MBM is administered to a subject in combination with ibrutinib (also called PCI-32765) (e.g., to a subject having CLL, MCL, or SLL). For example, the subject can have a deletion in the short arm of chromosome 17 (del(17p), e.g., in a leukemic cell). In other examples, the subject does not have a del(17p). In some embodiments, the subject has relapsed CLL or SLL, e.g., the subject has previously been administered a cancer therapy (e.g., previously been administered one, two, three, or four prior cancer therapies). In some embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In some embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al. (2013) Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at 55th ASH Annual Meeting and Exposition, New Orleans, LA 7-10 December Without being bound by theory, it is thought that the addition of ibrutinib enhances the T cell proliferative response and can shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In some embodiments, the MBM is administered in combination with an inhibitor of Epidermal Growth Factor Receptor (EGFR).

In some embodiments, the EGFR inhibitor is (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757.

In some embodiments, the EGFR inhibitor, e.g., (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757, is administered at a dose of 150-250 mg, e.g., per day. In some embodiments, the EGFR inhibitor, e.g., (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757, is administered at a dose of about 150, 200, or 250 mg, or about 150-200 or 200-250 mg.

In some embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757, is a covalent, irreversible tyrosine kinase inhibitor. In certain embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 inhibits activating EGFR mutations (L858R, ex19del). In other embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 does not inhibit, or does not substantially inhibit, wild-type (wt) EGFR. Compound A40 has shown efficacy in EGFR mutant NSCLC patients. In some embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 also inhibits one or more kinases in the TEC family of kinases. The Tec family kinases include, e.g., ITK, BMX, TEC, RLK, and BTK, and are central in the propagation of T-cell receptor and chemokine receptor signaling (Schwartzberg et al. (2005) *Nat. Rev. Immunol.* p. 284-95). For example, Compound A40 can inhibit ITK with a biochemical IC50 of 1.3 nM. ITK is a critical enzyme for the survival of Th2 cells and its inhibition results in a shift in the balance between Th2 and Th1 cells.

In some embodiments, the EGFR inhibitor is chosen from one of more of erlotinib, gefitinib, cetuximab, panitumumab, necitumumab, PF-00299804, nimotuzumab, or R05083945.

In some embodiments, the MBM is administered in combination with an adenosine A2A receptor (A2AR) antagonist. Exemplary A2AR antagonists include, e.g., PBF509 (Palobiofarma/Novartis), CPI444/V81444 (Corvus/Genentech), AZD4635/HTL-1071 (AstraZeneca/Heptares), Vipadenant (Redox/Juno), GBV-2034 (Globavir), AB928 (Arcus Biosciences), Theophylline, Istradefylline (Kyowa Hakko Kogyo), Tozadenant/SYN-115 (Acorda), KW-6356 (Kyowa Hakko Kogyo), ST-4206 (Leadiant Biosciences), Preladenant/SCH 420814 (Merck/Schering), and NIR178 (Novartis).

In certain embodiments, the A2AR antagonist is PBF509. PBF509 and other A2AR antagonists are disclosed in U.S. Pat. No. 8,796,284 and WO 2017/025918. In certain embodiments, the A2AR antagonist is 5-bromo-2,6-di-(1H-pyrazol-1-yl)pyrimidine-4-amine. In certain embodiments, the A2AR antagonist has the following structure:

In certain embodiments, the A2AR antagonist is CPI444/V81444. CPI-444 and other A2AR antagonists are disclosed in WO 2009/156737. In certain embodiments, the A2AR antagonist is (S)-7-(5-methylfuran-2-yl)-3-((6-(((tetrahydro-furan-3-yl)oxy)methyl)pyridin-2-yl)methyl)-3H-[1,2,3]tri-azolo[4,5-d]pyrimidin-5-amine. In certain embodiments, the A2AR antagonist is (R)-7-(5-methylfuran-2-yl)-3-((6-(((tet-rahydrofuran-3-yl)oxy)methyl)pyridin-2-yl)methyl)-3H-[1,2,3]triazolo[4,5-d]pyrimidin-5-amine, or racemate thereof. In certain embodiments, the A2AR antagonist is 7-(5-meth-ylfuran-2-yl)-3-((6-(((tetrahydrofuran-3-yl)oxy)methyl)pyridin-2-yl)methyl)-3H-[1,2,3]triazolo[4,5-d]pyrimidin-5-amine. In certain embodiments, the A2AR antagonist has the following structure:

In certain embodiments, the A2AR antagonist is AZD4635/HTL-1071. A2AR antagonists are disclosed in WO 2011/095625. In certain embodiments, the A2AR antagonist is 6-(2-chloro-6-methylpyridin-4-yl)-5-(4-fluoro-phenyl)-1,2,4-triazin-3-amine. In certain embodiments, the A2AR antagonist has the following structure:

In certain embodiments, the A2AR antagonist is ST-4206 (Leadiant Biosciences). In certain embodiments, the A2AR antagonist is an A2AR antagonist described in U.S. Pat. No. 9,133,197. In certain embodiments, the A2AR antagonist has the following structure:

In certain embodiments, the A2AR antagonist is an A2AR antagonist described in U.S. Pat. Nos. 8,114,845, 9,029,393, US20170015758, or US20160129108.

In certain embodiments, the A2AR antagonist is istrade-fylline (CAS Registry Number: 155270-99-8). Istradefylline is also known as KW-6002 or 8-[(E)-2-(3,4-dimethoxyphe-nyl)vinyl]-1,3-diethyl-7-methyl-3,7-dihydro-1H-purine-2, 6-dione. Istradefylline is disclosed, e.g., in LeWitt et al. (2008) *Annals of Neurology* 63 (3): 295-302).

In certain embodiments, the A2aR antagonist is tozade-nant (Biotie). Tozadenant is also known as SYN115 or 4-hydroxy-N-(4-methoxy-7-morpholin-4-yl-1,3-benzothi-azol-2-yl)-4-methylpiperidine-1-carboxamide. Tozadenant blocks the effect of endogenous adenosine at the A2a recep-tors, resulting in the potentiation of the effect of dopamine at the D2 receptor and inhibition of the effect of glutamate at the mGluR5 receptor. In some embodiments, the A2aR antagonist is preladenant (CAS Registry Number: 377727-87-2). Preladenant is also known as SCH 420814 or 2-(2-Furanyl)-7-[2-[4-[4-(2-methoxyethoxy)phenyl]-1-piperazi-nyl]ethyl]7H-pyrazolo[4,3-e][1,2,4]triazolo[1,5-c] pyrimidine-5-amine. Preladenant was developed as a drug that acted as a potent and selective antagonist at the adenos-ine A2A receptor.

In certain embodiments, the A2aR antagonist is vipade-nan. Vipadenan is also known as BIIB014, V2006, or 3-[(4-amino-3-methylphenyl)methyl]-7-(furan-2-yl)]tri-azolo[4,5-d]pyrimidin-5-amine.

Other exemplary A2aR antagonists include, e.g., ATL-444, MSX-3, SCH-58261, SCH-412,348, SCH-442,416, VER-6623, VER-6947, VER-7835, CGS-15943, or ZM-241,385.

In some embodiments, the A2aR antagonist is an A2aR pathway antagonist (e.g., a CD-73 inhibitor, e.g., an anti-CD73 antibody) is MED19447. MED19447 is a monoclonal antibody specific for CD73. Targeting the extracellular production of adenosine by CD73 may reduce the immunosuppressive effects of adenosine. MED19447 was reported to have a range of activities, e.g., inhibition of CD73 ectonucleotidase activity, relief from AMP-mediated lymphocyte suppression, and inhibition of syngeneic tumor growth. MED19447 can drive changes in both myeloid and lymphoid infiltrating leukocyte populations within the tumor microenvironment. These changes include, e.g., increases in CD8 effector cells and activated macrophages, as well as a reduction in the proportions of myeloid-derived suppressor cells (MDSC) and regulatory T lymphocytes.

In some embodiments, the MBM is administered in combination with a CAR-expressing cell therapy such as a CD19 CAR-expressing cell therapy.

In one embodiment, the antigen binding domain of the CD19 CAR has the same or a similar binding specificity as the FMC63 scFv fragment described in Nicholson et al. Mol. Immun. 34 (16-17): 1157-1165 (1997). In one embodiment, the antigen binding domain of the CD19 CAR includes the scFv fragment described in Nicholson et al. *Mol. Immun.* 34 (16-17): 1157-1165 (1997).

In some embodiments, the CD19 CAR includes an antigen binding domain (e.g., a humanized antigen binding domain) according to Table 3 of WO2014/153270. WO2014/153270 also describes methods of assaying the binding and efficacy of various CAR constructs.

In one aspect, the parental murine scFv sequence is the CAR19 construct provided in PCT publication WO2012/079000. In one embodiment, the anti-CD19 binding domain is a scFv described in WO2012/079000.

In one embodiment, the CAR molecule comprises the fusion polypeptide sequence provided as SEQ ID NO: 12 in PCT publication WO2012/079000, which provides an scFv fragment of murine origin that specifically binds to human CD19.

In one embodiment, the CD19 CAR comprises an amino acid sequence provided as SEQ ID NO: 12 in PCT publication WO2012/079000.

In one embodiment, the CD19 CAR has the USAN designation TISAGENLECLEUCEL-T. In embodiments, CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CD19 CAR comprises an antigen binding domain (e.g., a humanized antigen binding domain) according to Table 3 of WO2014/153270.

Humanization of murine CD19 antibody is desired for the clinical setting, where the mouse-specific residues can induce a human-anti-mouse antigen (HAMA) response in patients who receive CART19 treatment, i.e., treatment with T cells transduced with the CAR19 construct. The production, characterization, and efficacy of humanized CD19 CAR sequences is described in International Application WO2014/153270, including Examples 1-5 (p. 115-159).

In some embodiments, CD19 CAR constructs are described in PCT publication WO 2012/079000.

CD19 CAR constructs containing humanized anti-CD19 scFv domains are described in PCT publication WO 2014/153270.

Any known CD19 CAR, e.g., the CD19 antigen binding domain of any known CD19 CAR, in the art can be used in accordance with the present disclosure. For example, LG-740; CD19 CAR described in the U.S. Pat. Nos. 8,399, 645, 7,446,190; Xu et al., Leuk Lymphoma. 2013 54(2): 255-260(2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10.

Exemplary CD19 CARs include CD19 CARs described herein, or an anti-CD19 CAR described in Xu et al. Blood 123.24(2014):3750-9; Kochenderfer et al. Blood 122.25 (2013):4129-39, Cruz et al. Blood 122.17 (2013):2965-73,

| | | |
|---|---|---|
| NCT00586391, | NCT01087294, | NCT02456350, |
| NCT00840853, | NCT02659943, | NCT02650999, |
| NCT02640209, | NCT01747486, | NCT02546739, |
| NCT02656147, | NCT02772198, | NCT00709033, |
| NCT02081937, | NCT00924326, | NCT02735083, |
| NCT02794246, | NCT02746952, | NCT01593696, |
| NCT02134262, | NCT01853631, | NCT02443831, |
| NCT02277522, | NCT02348216, | NCT02614066, |
| NCT02030834, | NCT02624258, | NCT02625480, |
| NCT02030847, | NCT02644655, | NCT02349698, |
| NCT02813837, | NCT02050347, | NCT01683279, |
| NCT02529813, | NCT02537977, | NCT02799550, |
| NCT02672501, | NCT02819583, | NCT02028455, |
| NCT01840566, | NCT01318317, | NCT01864889, |
| NCT02706405, | NCT01475058, | NCT01430390, |
| NCT02146924, | NCT02051257, | NCT02431988, |
| NCT01815749, | NCT02153580, | NCT01865617, |
| NCT02208362, | NCT02685670, | NCT02535364, |
| NCT02631044, | NCT02728882, | NCT02735291, |
| NCT01860937, | NCT02822326, | NCT02737085, |
| NCT02465983, | NCT02132624, | NCT02782351, |
| NCT01493453, | NCT02652910, | NCT02247609, |
| NCT01029366, | NCT01626495, | NCT02721407, |
| NCT01044069, | NCT00422383, | NCT01680991, |

NCT02794961, or NCT02456207.

In some embodiments, the MBM is administered in combination with a CD20 inhibitor.

In one embodiment, the CD20 inhibitor is an anti-CD20 antibody or fragment thereof. In an embodiment, the antibody is a monospecific antibody and in another embodiment, the antibody is a bispecific antibody. In an embodiment, the CD20 inhibitor is a chimeric mouse/human monoclonal antibody, e.g., rituximab. In an embodiment, the CD20 inhibitor is a human monoclonal antibody such as ofatumumab. In an embodiment, the CD20 inhibitor is a humanized antibody such as ocrelizumab, veltuzumab, obinutuzumab, ocaratuzumab, or PRO131921 (Genentech). In an embodiment, the CD20 inhibitor is a fusion protein comprising a portion of an anti-CD20 antibody, such as TRU-015 (Trubion Pharmaceuticals).

In some embodiments, the MBM is administered in combination with a CD22 CAR-expressing cell therapy (e.g., cells expressing a CAR that binds to human CD22).

In some embodiments, the MBM is administered in combination with a CD22 inhibitor. In some embodiments, the CD22 inhibitor is a small molecule or an anti-CD22 antibody molecule. In some embodiments, the antibody is a monospecific antibody, optionally conjugated to a second agent such as a chemotherapeutic agent. For instance, in an embodiment, the antibody is an anti-CD22 monoclonal antibody-MMAE conjugate (e.g., DCDT2980S). In an embodiment, the antibody is an scFv of an anti-CD22 antibody, e.g., an scFv of antibody RFB4. This scFv can be fused to all of or a fragment of Pseudomonas exotoxin-A (e.g., BL22). In an embodiment, the antibody is a humanized anti-CD22 monoclonal antibody (e.g., epratuzumab). In an embodiment, the antibody or fragment thereof comprises the Fv portion of an anti-CD22 antibody, which is optionally covalently fused to all or a fragment or (e.g., a 38 KDa fragment of) Pseudomonas exotoxin-A (e.g., moxetumomab pasudotox). In an embodiment, the anti-CD22 antibody is an anti-CD19/CD22 bispecific antibody, optionally conjugated to a toxin. For instance, in one embodiment, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In another embodiment, the bispecific portion (e.g., anti-CD19/anti-CD22) is linked to a toxin such as deglycosylated ricin A chain (e.g., Combotox).

In some embodiments, the CD22 inhibitor is a multispecific antibody molecule, e.g., a bispecific antibody molecule, e.g., a bispecific antibody molecule that binds to CD20 and CD3. Exemplary bispecific antibody molecules that bind to CD20 and CD3 are disclosed in WO2016086189 and WO2016182751. In some embodiments, the bispecific antibody molecule that binds to CD20 and CD3 is XENP13676 as disclosed in FIG. 74, SEQ ID NOs: 323, 324, and 325 of WO2016086189.

In some embodiments, the CD22 CAR-expressing cell therapy includes an antigen binding domain according to WO2016/164731.

In some embodiments, the MBM is administered in combination with a FCRL2 or FCRL5 inhibitor. In some embodiments, the FCRL2 or FCRL5 inhibitor is an anti-FCRL2 antibody molecule, e.g., a bispecific antibody molecule, e.g., a bispecific antibody that binds to FCRL2 and CD3. In some embodiments, the FCRL2 or FCRL5 inhibitor is an anti-FCRL5 antibody molecule, e.g., a bispecific antibody molecule, e.g., a bispecific antibody that binds to FCRL5 and CD3. In some embodiments, the FCRL2 or FCRL5 inhibitor is a FCRL2 CAR-expressing cell therapy. In some embodiments, the FCRL2 or FCRL5 inhibitor is a FCRL5 CAR-expressing cell therapy.

Exemplary anti-FCRL5 antibody molecules are disclosed in US20150098900, US20160368985, WO2017096120 (e.g., antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 disclosed in WO2017096120).

Exemplary FCRL5 CAR molecules are disclosed in WO2016090337.

In some embodiments, the MBM is administered in combination with an IL15/IL-15Ra complex. In some embodiments, the 1L-15/IL-15Ra complex is chosen from NIZ985 (Novartis), ATL-803 (Altor) or CYP0150 (Cytune).

In some embodiments, the 1L-15/IL-15Ra complex comprises human IL-15 complexed with a soluble form of human IL-15Ra. The complex can comprise IL-15 covalently or noncovalently bound to a soluble form of IL-15Ra. In a particular embodiment, the human IL-15 is noncovalently bonded to a soluble form of IL-15Ra. In a particular embodiment, the human IL-15 of the composition comprises an amino acid sequence as described in WO 2014/066527 and the soluble form of human IL-15Ra comprises an amino acid sequence as described in WO 2014/066527. The molecules described herein can be made by vectors, host cells, and methods described in WO 2007/084342.

In some embodiments, the IL-15/IL-15Ra complex is ALT-803, an IL-15/IL-15Ra Fc fusion protein (IL-15N72D: IL-15RaSu/Fc soluble complex). ALT-803 is disclosed in WO 2008/143794.

In some embodiments, the IL-15/IL-15Ra complex comprises IL-15 fused to the sushi domain of IL-15Ra (CYP0150, Cytune). The sushi domain of IL-15Ra refers to a domain beginning at the first cysteine residue after the signal peptide of IL-15Ra, and ending at the fourth cysteine residue after the signal peptide. The complex of IL-15 fused to the sushi domain of IL-15Ra is disclosed in WO 2007/04606 and WO 2012/175222.

In some embodiments, the MBM is administered in combination with a PD-1 inhibitor. In some embodiments, the PD-1 inhibitor is chosen from PDR001 (Novartis), Nivolumab (Bristol-Myers Squibb), Pembrolizumab (Merck & Co), Pidilizumab (CureTech), MED10680 (Medimmune), REGN2810 (Regeneron), TSR-042 (Tesaro), PF-06801591 (Pfizer), BGB-A317 (Beigene), BGB-108 (Beigene), INCSHR1210 (Incyte), or AMP-224 (Amplimmune). In one embodiment, the PD-1 inhibitor is an anti-PD-1 antibody molecule. In one embodiment, the PD-1 inhibitor is an anti-PD-1 antibody molecule as described in US 2015/0210769.

In one embodiment, the anti-PD-1 antibody molecule is Nivolumab (Bristol-Myers Squibb), also known as MDX-1106, MDX-1106-04, ONO-4538, BMS-936558, or OPDIVO®. Nivolumab (clone 5C4) and other anti-PD-1 antibodies are disclosed in U.S. Pat. No. 8,008,449 and WO 2006/121168. In one embodiment, the anti-PD-1 antibody molecule comprises one or more of the CDR sequences (or collectively all of the CDR sequences), the heavy chain or light chain variable region sequence, or the heavy chain or light chain sequence of Nivolumab.

In one embodiment, the anti-PD-1 antibody molecule is Pembrolizumab (Merck & Co), also known as Lambrolizumab, MK-3475, MK03475, SCH-900475, or KEYTRUDA®. Pembrolizumab and other anti-PD-1 antibodies are disclosed in Hamid, O. et al. (2013) *New England Journal of Medicine* 369 (2): 134-44, U.S. Pat. No. 8,354,509, and WO 2009/114335. In one embodiment, the anti-PD-1 antibody molecule comprises one or more of the CDR sequences (or collectively all of the CDR sequences), the heavy chain or light chain variable region sequence, or the heavy chain or light chain sequence of Pembrolizumab.

In one embodiment, the anti-PD-1 antibody molecule is Pidilizumab (CureTech), also known as CT-011. Pidilizumab and other anti-PD-1 antibodies are disclosed in Rosenblatt, J. et al. (2011) *J Immunotherapy* 34(5): 409-18, U.S. Pat. Nos. 7,695,715, 7,332,582, and 8,686,119. In one embodiment, the anti-PD-1 antibody molecule comprises one or more of the CDR sequences (or collectively all of the CDR sequences), the heavy chain or light chain variable region sequence, or the heavy chain or light chain sequence of Pidilizumab.

In one embodiment, the anti-PD-1 antibody molecule is MED10680 (Medimmune), also known as AMP-514. MED10680 and other anti-PD-1 antibodies are disclosed in U.S. Pat. No. 9,205,148 and WO 2012/145493. In one embodiment, the anti-PD-1 antibody molecule comprises one or more of the CDR sequences (or collectively all of the CDR sequences), the heavy chain or light chain variable region sequence, or the heavy chain or light chain sequence of MED10680.

In one embodiment, the anti-PD-1 antibody molecule is REGN2810 (Regeneron). In one embodiment, the anti-PD-1 antibody molecule comprises one or more of the CDR sequences (or collectively all of the CDR sequences), the heavy chain or light chain variable region sequence, or the heavy chain or light chain sequence of REGN2810.

In one embodiment, the anti-PD-1 antibody molecule is PF-06801591 (Pfizer). In one embodiment, the anti-PD-1 antibody molecule comprises one or more of the CDR sequences (or collectively all of the CDR sequences), the heavy chain or light chain variable region sequence, or the heavy chain or light chain sequence of PF-06801591.

In one embodiment, the anti-PD-1 antibody molecule is BGB-A317 or BGB-108 (Beigene). In one embodiment, the anti-PD-1 antibody molecule comprises one or more of the CDR sequences (or collectively all of the CDR sequences), the heavy chain or light chain variable region sequence, or the heavy chain or light chain sequence of BGB-A317 or BGB-108.

In one embodiment, the anti-PD-1 antibody molecule is INCSHR1210 (Incyte), also known as INCSHR01210 or SHR-1210. In one embodiment, the anti-PD-1 antibody molecule comprises one or more of the CDR sequences (or collectively all of the CDR sequences), the heavy chain or light chain variable region sequence, or the heavy chain or light chain sequence of INCSHR1210.

In one embodiment, the anti-PD-1 antibody molecule is TSR-042 (Tesaro), also known as ANB011. In one embodiment, the anti-PD-1 antibody molecule comprises one or more of the CDR sequences (or collectively all of the CDR sequences), the heavy chain or light chain variable region sequence, or the heavy chain or light chain sequence of TSR-042.

Further known anti-PD-1 antibodies include those described, e.g., in WO 2015/112800, WO 2016/092419, WO 2015/085847, WO 2014/179664, WO 2014/194302, WO 2014/209804, WO 2015/200119, U.S. Pat. Nos. 8,735,553, 7,488,802, 8,927,697, 8,993,731, and 9,102,727.

In one embodiment, the anti-PD-1 antibody is an antibody that competes for binding with, and/or binds to the same epitope on PD-1 as, one of the anti-PD-1 antibodies described herein.

In one embodiment, the PD-1 inhibitor is a peptide that inhibits the PD-1 signaling pathway, e.g., as described in U.S. Pat. No. 8,907,053. In one embodiment, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In one embodiment, the PD-1 inhibitor is AMP-224 (B7-DCIg (Amplimmune), e.g., disclosed in WO 2010/027827 and WO 2011/066342).

In some embodiments, the MBM is administered in combination with a PD-L1 inhibitor. In some embodiments, the PD-L1 inhibitor is chosen from FAZ053 (Novartis), Atezolizumab (Genentech/Roche), Avelumab (Merck Serono and Pfizer), Durvalumab (MedImmune/AstraZeneca), or BMS-936559 (Bristol-Myers Squibb).

In one embodiment, the PD-L1 inhibitor is an anti-PD-L1 antibody molecule. In one embodiment, the PD-L1 inhibitor is an anti-PD-L1 antibody molecule as disclosed in US 2016/0108123.

In one embodiment, the anti-PD-L1 antibody molecule is Atezolizumab (Genentech/Roche), also known as MPDL3280A, RG7446, RO5541267, YW243.55.S70, or TECENTRIQ™. Atezolizumab and other anti-PD-L1 antibodies are disclosed in U.S. Pat. No. 8,217,149. In one embodiment, the anti-PD-L1 antibody molecule comprises one or more of the CDR sequences (or collectively all of the CDR sequences), the heavy chain or light chain variable region sequence, or the heavy chain or light chain sequence of Atezolizumab.

In one embodiment, the anti-PD-L1 antibody molecule is Avelumab (Merck Serono and Pfizer), also known as MSB0010718C. Avelumab and other anti-PD-L1 antibodies are disclosed in WO 2013/079174. In one embodiment, the anti-PD-L1 antibody molecule comprises one or more of the CDR sequences (or collectively all of the CDR sequences), the heavy chain or light chain variable region sequence, or the heavy chain or light chain sequence of Avelumab.

In one embodiment, the anti-PD-L1 antibody molecule is Durvalumab (MedImmune/AstraZeneca), also known as MED14736. Durvalumab and other anti-PD-L1 antibodies are disclosed in U.S. Pat. No. 8,779,108. In one embodiment, the anti-PD-L1 antibody molecule comprises one or more of the CDR sequences (or collectively all of the CDR sequences), the heavy chain or light chain variable region sequence, or the heavy chain or light chain sequence of Durvalumab.

In one embodiment, the anti-PD-L1 antibody molecule is BMS-936559 (Bristol-Myers Squibb), also known as MDX-1105 or 12A4. BMS-936559 and other anti-PD-L1 antibodies are disclosed in U.S. Pat. No. 7,943,743 and WO 2015/081158. In one embodiment, the anti-PD-L1 antibody molecule comprises one or more of the CDR sequences (or collectively all of the CDR sequences), the heavy chain or light chain variable region sequence, or the heavy chain or light chain sequence of BMS-936559.

Further known anti-PD-L1 antibodies include those described, e.g., in WO 2015/181342, WO 2014/100079, WO 2016/000619, WO 2014/022758, WO 2014/055897, WO 2015/061668, WO 2013/079174, WO 2012/145493, WO 2015/112805, WO 2015/109124, WO 2015/195163, U.S. Pat. Nos. 8,168,179, 8,552,154, 8,460,927, and 9,175,082.

In some embodiments, the MBM is administered in combination with a LAG-3 inhibitor. In some embodiments, the LAG-3 inhibitor is chosen from LAG525 (Novartis), BMS-986016 (Bristol-Myers Squibb), or TSR-033 (Tesaro).

In one embodiment, the LAG-3 inhibitor is an anti-LAG-3 antibody molecule. In one embodiment, the LAG-3 inhibitor is an anti-LAG-3 antibody molecule as disclosed in US 2015/0259420.

In one embodiment, the anti-LAG-3 antibody molecule is BMS-986016 (Bristol-Myers Squibb), also known as BMS986016. BMS-986016 and other anti-LAG-3 antibodies are disclosed in WO 2015/116539 and U.S. Pat. No. 9,505,839. In one embodiment, the anti-LAG-3 antibody molecule comprises one or more of the CDR sequences (or collectively all of the CDR sequences), the heavy chain or light chain variable region sequence, or the heavy chain or light chain sequence of BMS-986016.

In one embodiment, the anti-LAG-3 antibody molecule is TSR-033 (Tesaro). In one embodiment, the anti-LAG-3 antibody molecule comprises one or more of the CDR sequences (or collectively all of the CDR sequences), the heavy chain or light chain variable region sequence, or the heavy chain or light chain sequence of TSR-033.

In one embodiment, the anti-LAG-3 antibody molecule is IMP731 or GSK2831781 (GSK and Prima BioMed). IMP731 and other anti-LAG-3 antibodies are disclosed in WO 2008/132601 and U.S. Pat. No. 9,244,059. In one embodiment, the anti-LAG-3 antibody molecule comprises one or more of the CDR sequences (or collectively all of the CDR sequences), the heavy chain or light chain variable region sequence, or the heavy chain or light chain sequence of IMP731. In one embodiment, the anti-LAG-3 antibody molecule comprises one or more of the CDR sequences (or collectively all of the CDR sequences), the heavy chain or light chain variable region sequence, or the heavy chain or light chain sequence of GSK2831781.

Further known anti-LAG-3 antibodies include those described, e.g., in WO 2008/132601, WO 2010/019570, WO 2014/140180, WO 2015/116539, WO 2015/200119, WO 2016/028672, U.S. Pat. Nos. 9,244,059, 9,505,839.

In one embodiment, the anti-LAG-3 inhibitor is a soluble LAG-3 protein, e.g., IMP321 (Prima BioMed), e.g., as disclosed in WO 2009/044273.

In some embodiments, the MBM is administered in combination with a TIM-3 inhibitor. In some embodiments, the TIM-3 inhibitor is MBG453 (Novartis) or TSR-022 (Tesaro).

In one embodiment, the TIM-3 inhibitor is an anti-TIM-3 antibody molecule. In one embodiment, the TIM-3 inhibitor is an anti-TIM-3 antibody molecule as disclosed in US 2015/0218274.

In one embodiment, the anti-TIM-3 antibody molecule is TSR-022 (AnaptysBio/Tesaro). In one embodiment, the anti-TIM-3 antibody molecule comprises one or more of the CDR sequences (or collectively all of the CDR sequences), the heavy chain or light chain variable region sequence, or the heavy chain or light chain sequence of TSR-022. In one embodiment, the anti-TIM-3 antibody molecule comprises one or more of the CDR sequences (or collectively all of the CDR sequences), the heavy chain or light chain variable region sequence, or the heavy chain or light chain sequence of APE5137 or APE5121. APE5137, APE5121, and other anti-TIM-3 antibodies are disclosed in WO 2016/161270.

In one embodiment, the anti-TIM-3 antibody molecule is the antibody clone F38-2E2. In one embodiment, the anti-TIM-3 antibody molecule comprises one or more of the CDR sequences (or collectively all of the CDR sequences), the heavy chain or light chain variable region sequence, or the heavy chain or light chain sequence of F38-2E2.

Further known anti-TIM-3 antibodies include those described, e.g., in WO 2016/111947, WO 2016/071448, WO 2016/144803, U.S. Pat. Nos. 8,552,156, 8,841,418, and 9,163,087.

In one embodiment, the anti-TIM-3 antibody is an antibody that competes for binding with, and/or binds to the same epitope on TIM-3 as, one of the anti-TIM-3 antibodies described herein.

In some embodiments, the MBM is administered in combination with a transforming growth factor beta (TGF-β) inhibitor. In some embodiments, the TGF-β inhibitor is fresolimumab (CAS Registry Number: 948564-73-6). Fresolimumab is also known as GC1008. Fresolimumab is a human monoclonal antibody that binds to and inhibits TGF-beta isoforms 1, 2 and 3. Fresolimumab is disclosed, e.g., in WO 2006/086469, U.S. Pat. Nos. 8,383,780, and 8,591,901.

In some embodiments, the TGF-13 inhibitor is XOMA 089. XOMA 089 is also known as XPA.42.089. XOMA 089 is a fully human monoclonal antibody that binds and neutralizes TGF-beta 1 and 2 ligands, and is disclosed in PCT Publication No. WO 2012/167143.

In some embodiments, the MBM is administered in combination with an anti-CD73 antibody molecule. In one embodiment, an anti-CD73 antibody molecule is a full antibody molecule or an antigen-binding fragment thereof. In certain embodiments, the anti-CD73 antibody molecule binds to a CD73 protein and reduces, e.g., inhibits or antagonizes, an activity of CD73, e.g., human CD73.

In one embodiment, the anti-CD73 antibody molecule is an anti-CD73 antibody disclosed in WO2016/075099. In one embodiment, the anti-CD73 antibody molecule is MEDI 9447, e.g., as disclosed in WO2016/075099. Alternative names for MEDI 9447 include clone 10.3 or 73combo3. MEDI 9447 is an IgG1 antibody that inhibits, e.g., antagonizes, an activity of CD73. MEDI 9447 and other anti-CD73 antibody molecules are also disclosed in WO2016/075176 and US2016/0129108.

In one embodiment, the anti-CD73 antibody molecule comprises a heavy chain variable domain, a light chain variable domain, or both, of MEDI 9477.

In one embodiment, the anti-CD73 antibody molecule is an anti-CD73 antibody disclosed in WO2016/081748. In one embodiment, the anti-CD73 antibody molecule is 11F11, e.g., as disclosed in WO2016/081748. 11F11 is an IgG2 antibody that inhibits, e.g., antagonizes, an activity of CD73. Antibodies derived from 11F11, e.g., CD73.4, and CD73.10; clones of 11F11, e.g., 11F11-1 and 11F11-2; and other anti-CD73 antibody molecules are disclosed in WO2016/081748 and U.S. Pat. No. 9,605,080.

In one embodiment, the anti-CD73 antibody molecule comprises a heavy chain variable domain, a light chain variable domain, or both, of 11F11-1 or 11F11-2.

In one embodiment, the anti-CD73 antibody molecule is an anti-CD73 antibody disclosed in e.g., U.S. Pat. No. 9,605,080.

In one embodiment, the anti-CD73 antibody molecule is CD73.4, e.g., as disclosed in U.S. Pat. No. 9,605,080. In one embodiment, the anti-CD73 antibody molecule comprises a heavy chain variable domain, a light chain variable domain, or both, of CD73.4.

In one embodiment, the anti-CD73 antibody molecule is CD73.10, e.g., as disclosed in U.S. Pat. No. 9,605,080. In one embodiment, the anti-CD73 antibody molecule comprises a heavy chain variable domain, a light chain variable domain, or both, of CD73.10.

In one embodiment, the anti-CD73 antibody molecule is an anti-CD73 antibody disclosed in WO2009/0203538. In one embodiment, the anti-CD73 antibody molecule is 067-213, e.g., as disclosed in WO2009/0203538.

In one embodiment, the anti-CD73 antibody molecule comprises a heavy chain variable domain, a light chain variable domain, or both, of 067-213.

In one embodiment, the anti-CD73 antibody molecule is an anti-CD73 antibody disclosed in U.S. Pat. No. 9,090,697. In one embodiment, the anti-CD73 antibody molecule is TY, 23, e.g., as disclosed in U.S. Pat. No. 9,090,697. In one embodiment, the anti-CD73 antibody molecule comprises a heavy chain variable domain, a light chain variable domain, or both, of TY, 23.

In one embodiment, the anti-CD73 antibody molecule is an anti-CD73 antibody disclosed in WO2016/055609. In one embodiment, the anti-CD73 antibody molecule comprises a heavy chain variable domain, a light chain variable domain, or both, of an anti-CD73 antibody disclosed in WO2016/055609.

In one embodiment, the anti-CD73 antibody molecule is an anti-CD73 antibody disclosed in WO2016/146818. In one embodiment, the anti-CD73 antibody molecule comprises a heavy chain variable domain, a light chain variable domain, or both, of an anti-CD73 antibody disclosed in WO2016/146818.

In one embodiment, the anti-CD73 antibody molecule is an anti-CD73 antibody disclosed in WO2004/079013. In one embodiment, the anti-CD73 antibody molecule comprises a heavy chain variable domain, a light chain variable domain, or both, of an anti-CD73 antibody disclosed in WO2004/079013.

In one embodiment, the anti-CD73 antibody molecule is an anti-CD73 antibody disclosed in WO2012/125850. In one embodiment, the anti-CD73 antibody molecule comprises a heavy chain variable domain, a light chain variable domain, or both, of an anti-CD73 antibody disclosed in WO2012/125850.

In one embodiment, the anti-CD73 antibody molecule is an anti-CD73 antibody disclosed in WO2015/004400. In one embodiment, the anti-CD73 antibody molecule comprises a heavy chain variable domain, a light chain variable domain, or both, of an anti-CD73 antibody disclosed in WO2015/004400.

In one embodiment, the anti-CD73 antibody molecule is an anti-CD73 antibody disclosed in WO2007/146968. In one embodiment, the anti-CD73 antibody molecule comprises a heavy chain variable domain, a light chain variable domain, or both, of an anti-CDb 73 antibody disclosed in WO2007146968.

In one embodiment, the anti-CD73 antibody molecule is an anti-CD73 antibody disclosed in US2007/0042392. In one embodiment, the anti-CD73 antibody molecule comprises a heavy chain variable domain, a light chain variable domain, or both, of an anti-CD73 antibody disclosed in US2007/0042392.

In one embodiment, the anti-CD73 antibody molecule is an anti-CD73 antibody disclosed in US2009/0138977. In one embodiment, the anti-CD73 antibody molecule comprises a heavy chain variable domain, a light chain variable domain, or both, of an anti-CD73 antibody disclosed in US2009/0138977.

In one embodiment, the anti-CD73 antibody molecule is an anti-CD73 antibody disclosed in Flocke et al., Eur J Cell Biol. 1992 June; 58(1):62-70. In one embodiment, the anti-CD73 antibody molecule comprises a heavy chain variable domain, a light chain variable domain, or both, of an anti-CD73 antibody disclosed in Flocke et al., Eur J Cell Biol. 1992 June; 58(1):62-70.

In one embodiment, the anti-CD73 antibody molecule is an anti-CD73 antibody disclosed in Stagg et al., PNAS. 2010 January 107(4): 1547-1552. In some embodiments, the anti-CD73 antibody molecule is TY, 23 or TY11.8, as disclosed in Stagg et al. In one embodiment, the anti-CD73 antibody molecule comprises a heavy chain variable domain, a light chain variable domain, or both, of an anti-CD73 antibody disclosed in Stagg et al.

In some embodiments, the MBM is administered in combination with an interleukine-17 (IL-17) inhibitor.

In some embodiments, the IL-17 inhibitor is secukinumab (CAS Registry Numbers: 875356-43-7 (heavy chain) and 875356-44-8 (light chain)). Secukinumab is also known as AIN457 and COSENTYX®. Secukinumab is a recombinant human monoclonal IgG1/K antibody that binds specifically to IL-17A. It is expressed in a recombinant Chinese Hamster Ovary (CHO) cell line. Secukinumab is described, e.g., in WO 2006/013107, U.S. Pat. Nos. 7,807,155, 8,119,131, 8,617,552, and EP 1776142.

In some embodiments, the IL-17 inhibitor is CJM112. CJM112 is also known as XAB4. CJM112 is a fully human monoclonal antibody (e.g., of the IgG1/K isotype) that targets IL-17A. CJM112 is disclosed, e.g., in WO 2014/122613.

CJM112 can bind to human, cynomolgus, mouse and rat IL-17A and neutralize the bioactivity of these cytokines in vitro and in vivo. IL-17A, a member of the IL-17 family, is a major proinflammatory cytokine that has been indicated to play important roles in many immune mediated conditions, such as psoriasis and cancers (Witowski et al. (2004) Cell Mol. Life Sci. p. 567-79; Miossec and Kolls (2012) Nat. Rev. Drug Discov. p. 763-76).

In some embodiments, the IL-17 inhibitor is ixekizumab (CAS Registry Number: 1143503-69-8). Ixekizumab is also known as LY2439821. Ixekizumab is a humanized IgG4 monoclonal antibody that targets IL-17A. Ixekizumab is described, e.g., in WO 2007/070750, U.S. Pat. Nos. 7,838, 638, and 8,110,191.

In some embodiments, the IL-17 inhibitor is brodalumab (CAS Registry Number: 1174395-19-7). Brodalumab is also known as AMG 827 or AM-14. Brodalumab binds to the interleukin-17 receptor A (IL-17RA) and prevents IL-17 from activating the receptor. Brodalumab is disclosed, e.g., in WO 2008/054603, U.S. Pat. Nos. 7,767,206, 7,786,284, 7,833,527, 7,939,070, 8,435,518, 8,545,842, 8,790,648, and 9,073,999.

In some embodiments, the MBM is administered in combination with an interleukine-1 beta (IL-1β) inhibitor.

In some embodiments, the IL-1β inhibitor is canakinumab. Canakinumab is also known as ACZ885 or ILARIS®. Canakinumab is a human monoclonal IgG1/K antibody that neutralizes the bioactivity of human IL-1β. Canakinumab is disclosed, e.g., in WO 2002/16436, U.S. Pat. No. 7,446,175, and EP 1313769.

In some embodiments, the MBM is administered in combination with a CD32B inhibitor. In some embodiments, the CD32B inhibitor is an anti-CD32B antibody molecule. Exemplary anti-CD32B antibody molecules are disclosed in U.S. Pat. Nos. 8,187,593, 8,778,339, 8,802,089, US20060073142, US20170198040, and US20130251706.

In some embodiments, the MBM is administered in combination with one of the compounds listed in Table 18.

TABLE 18

| Compound Desig- nation | Generic Name Tradename | Compound Structure | Patents/Patent Application Publications |
|---|---|---|---|
| A1 | Sotrastaurin | | EP 1682103 US 2007/142401 WO 2005/039549 |
| A2 | Nilotinib HCl monohydrate TASIGNA ® |  HCl • H₂O | WO 2004/005281 U.S. Pat. No. 7,169,791 |
| A3 | | | WO 2009/141386 US 2010/0105667 |

TABLE 18-continued

| Compound Designation | Generic Name Tradename | Compound Structure | Patents/Patent Application Publications |
|---|---|---|---|
| A4 | | | WO 2010/029082 |
| A5 | | | WO 2011/076786 |
| A6 | Deferasirox EXJADE ® | | WO 1997/049395 |
| A7 | Letrozole FEMARA ® | | U.S. Pat. No. 4,978,672 |

TABLE 18-continued

| Compound Desig- nation | Generic Name Tradename | Compound Structure | Patents/Patent Application Publications |
|---|---|---|---|
| A8 | | | WO 2013/124826 US 2013/0225574 |
| A9 | | | WO 2013/111105 |
| A10 | BLZ945 | | WO 2007/121484 |

TABLE 18-continued

| Compound Desig- nation | Generic Name Tradename | Compound Structure | Patents/Patent Application Publications |
|---|---|---|---|
| A11 | Imatinib mesylate GLEEVEC ® | Mesylate | WO 1999/003854 |
| A12 | Capmatinib | Dihydrochloric salt | EP 2099447 U.S. Pat. No. 7,767,675 U.S. Pat. No. 8,420,645 |
| A13 | Ruxolitinib Phosphate JAKAFI ® | H₃PO₄ | WO 2007/070514 EP 2474545 U.S. Pat. No. 7,598,257 WO 2014/018632 |

TABLE 18-continued

| Compound Desig- nation | Generic Name Tradename | Compound Structure | Patents/Patent Application Publications |
|---|---|---|---|
| A14 | Panobinostat | | WO 2014/072493 WO 2002/022577 EP 1870399 |
| A15 | Osilodrostat | | WO 2007/024945 |
| A16 | | | WO 2008/016893 EP 2051990 U.S. Pat. No. 8,546,336 |
| A17 | ceritinib ZYKADIA ™ | | WO 2008/073687 U.S. Pat. No. 8,039,479 |
| A18 | Ribociclib KISQALI ® | | U.S. Pat. No. 8,415,355 U.S. Pat. No. 8,685,980 |

TABLE 18-continued

| Compound Designation | Generic Name Tradename | Compound Structure | Patents/Patent Application Publications |
|---|---|---|---|
| A19 | | | WO 2010/007120 |
| A20 | | Human monoclonal antibody to PRLR | U.S. Pat. No. 7,867,493 |
| A21 | | | WO 2010/026124 EP 2344474 US 2010/0056576 WO2008/106692 |
| A22 | WNT974 | | WO 2010/101849 |

TABLE 18-continued

| Compound Desig- nation | Generic Name Tradename | Compound Structure | Patents/Patent Application Publications |
|---|---|---|---|
| A23 | | | WO 2011/101409 |
| A24 | | Human monoclonal antibody to HER3, , e.g., LJM716 | WO 2012/022814 EP 2606070 U.S. Pat. No. 8,735,551 |
| A25 | | Antibody Drug Conjugate (ADC) | WO 2014/160160, e.g., Ab: 12425 (see Table 1, paragraph [00191]) Linker: SMCC (see paragraph [00117] Payload: DM1 (see paragraph [00111] See also Claim 29 |
| A26 | | Monoclonal antibody or Fab to M-CSF, e.g., MCS110 | WO 2004/045532 |
| A27 | Midostaurin | | WO 2003/037347 EP 1441737 US 2012/252785 |

TABLE 18-continued

| Compound Designation | Generic Name Tradename | Compound Structure | Patents/Patent Application Publications |
|---|---|---|---|
| A28 | Everolimus AFINITOR ® | | WO 2014/085318 |
| A29 | | | WO 2007/030377 U.S. Pat. No. 7,482,367 |
| A30 | Pasireotide diaspartate SIGNIFOR ® | | U.S. Pat. No. 7,473,761 |

TABLE 18-continued

| Compound Desig- nation | Generic Name Tradename | Compound Structure | Patents/Patent Application Publications |
|---|---|---|---|
| A31 | | | WO 2013/184757 |
| A32 | | | WO 2006/122806 |
| A33 | | | WO 2008/073687 U.S. Pat. No. 8,372,858 |

TABLE 18-continued

| Compound Desig-nation | Generic Name Tradename | Compound Structure | Patents/Patent Application Publications |
|---|---|---|---|
| A34 | | | WO 2010/002655 U.S. Pat. No. 8,519,129 |
| A35 | | | WO 2010/002655 U.S. Pat. No. 8,519,129 |

TABLE 18-continued

| Compound Designation | Generic Name Tradename | Compound Structure | Patents/Patent Application Publications |
|---|---|---|---|
| A36 | | | WO 2010/002655 |
| A37 | Valspodar AMDRAY ™ | | EP 296122 |
| A38 | Vatalanib succinate | | WO 98/35958 | succinate

TABLE 18-continued

| Compound Desig- nation | Generic Name Tradename | Compound Structure | Patents/Patent Application Publications |
|---|---|---|---|
| A39 | | IDH inhibitor, e.g., IDH305 | WO2014/141104 |
| A40 | Asciminib | BCR-ABL inhibitor | WO2013/171639 WO2013/171640 WO2013/171641 WO2013/171642 |
| A41 | | cRAF inhibitor | WO2014/151616 |
| A42 | | ERK1/2 ATP competitive inhibitor | WO2015/066188 |
| A43 | | | WO2011/023773 |
| A44 | | | WO2012/149413 |
| A45 | SHP099 | | WO2015/107493 |
| A46 | | SHP2 inhibitor of Formula I | WO2015/107495 |
| A47 | | | WO2015/022662 |

TABLE 18-continued

| Compound Designation | Generic Name Tradename | Compound Structure | Patents/Patent Application Publications |
|---|---|---|---|
| A48 | | | WO2014/141104 |
| A49 | | <br>or a choline salt thereof | WO2010/015613<br>WO2013030803<br>U.S. Pat. No. 7,989,497, |
| A50 | | A2A receptor antagonist of Formula (I) | WO 2017/025918<br>WO2011/121418<br>U.S. Pat. No. 8,796,284 |
| A51 | | | WO2014/130310 |
| A52 | trametinib | | WO2005/121142<br>U.S. Pat. No. 7,378,423 |

TABLE 18-continued

| Compound Desig- nation | Generic Name Tradename | Compound Structure | Patents/Patent Application Publications |
|---|---|---|---|
| A53 | dabrafenib | | WO 2009/137391 U.S. Pat. No. 7,994,185 |
| A54 | octreotide | | U.S. Pat. No. 4,395,403 EP 0 029 579 |
| A55 | | | WO 2016/103155 U.S. Pat. No. 9,580,437 EP 3237418 |
| A56 | | | U.S. Pat. No. 9,512,084 WO/2015/079417 |

TABLE 18-continued

| Compound Designation | Generic Name Tradename | Compound Structure | Patents/Patent Application Publications |
|---|---|---|---|
| A57 | | | WO2011/049677 |

In some embodiments, a MBM is administered in combination with one or more of a CAR-T therapy, NIZ985, a GITR agonist such as GWN323, PTK787, MBG453, mAb12425, CLR457, BGT226, BYL719, AMN107, ABL001, IDH305/LQS305, LJM716, MCS110, WNT974/LGK974, BLZ945, NIR178, QBM076, MBG453, CGS-20267, LHS534, LKG960, LDM099/SHP099, TNO155, LCL161, MAP855/LQN716, RAD001, LEJ511, LDK378, LOU064, LSZ102, LEQ506, RAF265/CHIR265, canakinumab, gevokizumab, Anakinra, Rilonacept, CGS-20267, PSC833, GGP-57148B, CGM097, HDM201, LBH589, PKC412, LHC165, MAK683, INC280, INC424, LJE704, LAG525, and NIS793.

In some embodiments, the MBM is administered in combination with a standard treatment.

Standard treatment for multiple myeloma and associated diseases includes chemotherapy, stem cell transplant (autologous or allogeneic), radiation therapy, and other drug therapies. Frequently used anti-myeloma drugs include alkylating agents (e.g., bendamustine, cyclophosphamide and melphalan), proteasome inhibitors (e.g., bortezomib), corticosteroids (e.g., dexamethasone and prednisone), and immunomodulators (e.g., thalidomide and lenalidomide or Revlimid®), or any combination thereof. Biphosphonate drugs are also frequently administered in combination with the standard anti-MM treatments to prevent bone loss. Patients older than 65-70 years of age are unlikely candidates for stem cell transplant. In some cases, double-autologous stem cell transplants are options for patients less than 60 years of age with suboptimal response to the first transplant. The compositions and methods of the present disclosure can be administered in combination with any one of the currently prescribed treatments for multiple myeloma.

Hodgkin's lymphoma is commonly treated with radiation therapy, chemotherapy, or hematopoietic stem cell transplantation. The most common therapy for non-Hodgkin's lymphoma is R-CHOP, which consists of four different chemotherapies (cyclophosphamide, doxorubicin, vincristine, and prenisolone) and rituximab (Rituxan®). Other therapies commonly used to treat NHL include other chemotherapeutic agents, radiation therapy, stem cell transplantation (autologous or allogeneic bone marrow transplantation), or biological therapy, such as immunotherapy. Other examples of biological therapeutic agents include, but are not limited to, rituximab (Rituxan®), tositumomab (Bexxar®), epratuzumab (LymphoCide®), and alemtuzumab (MabCampath®). The compositions and methods of the present disclosure can be administered in combination with any one of the currently prescribed treatments for Hodgkin's lymphoma or non-Hodgkin's lymphoma.

Standard treatment for WM consists of chemotherapy, specifically with rituximab (Rituxan®). Other chemotherapeutic drugs can be used in combination, such as chlorambucil (Leukeran®), cyclophosphamide (Neosar®), fludarabine (Fludara®), cladribine (Leustatin®), vincristine, and/or thalidomide. Corticosteriods, such as prednisone, can also be administered in combination with the chemotherapy. Plasmapheresis, or plasma exchange, is commonly used throughout treatment of the patient to alleviate some symptoms by removing the paraprotein from the blood. In some cases, stem cell transplantation is an option for some patients.

MBMs having an ABM2 that binds to CD3 can be administered in combination with an agent which reduces or ameliorates a side effect associated with the administration of a MBM that binds to CD3. Side effects associated with the administration of CD3 binders include, but are not limited to, cytokine release syndrome ("CRS") and hemophagocytic lymphohistiocytosis (HLH), also termed Macrophage Activation Syndrome (MAS). Symptoms of CRS can include high fevers, nausea, transient hypotension, hypoxia, and the like. CRS can include clinical constitutional signs and symptoms such as fever, fatigue, anorexia, myalgias, arthalgias, nausea, vomiting, and headache. CRS can include clinical skin signs and symptoms such as rash. CRS can include clinical gastrointestinal signs and symptoms such as nausea, vomiting and diarrhea. CRS can include clinical respiratory signs and symptoms such as tachypnea and hypoxemia. CRS can include clinical cardiovascular signs and symptoms such as tachycardia, widened pulse pressure, hypotension, increased cardiac output (early) and potentially diminished cardiac output (late). CRS can include clinical coagulation signs and symptoms such as elevated d-dimer, hypofibrinogenemia with or without bleeding. CRS can include clinical renal signs and symptoms such as azotemia. CRS can include clinical hepatic signs and symptoms such as transaminitis and hyperbilirubinemia. CRS can include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a MBM having an ABM2 that binds to CD3 to a subject and further administering one or more agents to manage elevated levels of a soluble factor resulting from treatment with the MBM. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFα, and inhibitor of IL-1R, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, ONTO 328, ALD518/BMS-945429, ONTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others. In some embodiments, the subject is administered a corticosteroid, e.g., methylprednisolone, hydrocortisone, in combination with Benadryl and Tylenol prior to the administration of a MBM that binds CD3 to mitigate the CRS risk.

In some embodiments, the subject is administered a vasopressor, such as, e.g., norepinephrine, dopamine, phenylephrine, epinephrine, vasopressin, or any combination thereof.

In an embodiment, the subject can be administered an antipyretic agent. In an embodiment, the subject can be administered an analgesic agent.

8. EXAMPLES

8.1. Example 1: Production and Characterization of Anti-BCMA Antibodies

Anti-BCMA antibodies that are cross-reactive with both human and cynomolgus BCMA were identified using phage display. Affinity maturation of a selected antibody, designated R1F2 in Table 11, was performed to produce antibodies having increased affinity for BCMA. Several additional anti-BCMA antibodies derived from the parental R1F2 antibody were obtained. These antibodies are designated as "AB1/AB2 Family" binders in Table 11. Another antibody separately identified using phage display, designated PI-61 in Table 11, was also subjected to affinity maturation to produce clones having increased affinity for BCMA. Several additional anti-BCMA antibodies derived from the parental PI-61 antibody were obtained. These antibodies are designated as "AB3 Family" binders in Table 11.

Anti-BCMA x anti-CD3 bispecific antibodies having VH and VL sequences of AB1, AB2, and AB3 were produced. The bispecific antibodies were found to be active in in vitro RTCC assays with BCMA+ multiple myeloma cell lines and found to have anti-tumor activity in a KMS11-Luc multiple myeloma orthotopic tumor model in NSG mice.

8.2. Example 2: Production and Characterization of TBMs Binding BCMA, a Component of a TCR Complex, and CD2

TBMs having a BCMA ABM comprising VH and VL sequences of AB3, a TCR ABM, and a CD2 ABM were produced in a knob-into-hole (KIH) format and characterized. The TBMs of this Example are shown schematically in FIGS. 2A-2B. Each TBM of this Example comprises a first half antibody (shown schematically as the left half of each construct shown in FIGS. 2A-2B) and a second half antibody (shown schematically as the right half of each construct shown in FIGS. 2A-2B). Without being bound by theory, it is believed that combining CD2 and TCR complex-engagement in a TBM can stimulate both a primary signaling pathway that promotes T-cell mediated lysis of tumor cells (by clustering TCRs, for example) and a second co-stimulatory pathway to induce T-cell proliferation and potentially overcome anergy.

8.2.1. Materials and Methods
8.2.1.1. Plasmids Encoding TBMs

Plasmids encoding proteins for two TBMs targeting BCMA, a component of a TCR complex and CD2 were synthesized.

For the first TBM (shown schematically in FIG. 2A), a plasmid encoding a codon optimized anti-BCMA heavy chain was synthesized as a fusion comprising (in the N-terminal to C-terminal direction) (i) the AB3 VH domain fused to a constant hIgG1 CH1 domain (ii) a linker, (iii) an anti-TCR scFv corresponding to BMA031, (iv) a second linker, and (v) a hIgG1 Fc region containing T366S, L368A, and Y407V mutations for a hole to facilitate heterodimerization of the TBM as well as silencing mutations. A plasmid encoding a light chain was synthesized as a fusion comprising (in the N-terminal to C-terminal direction) the AB3 VL domain and the constant human lambda sequence. A plasmid encoding the second half antibody was synthesized as a fusion comprising (in the N-terminal to C-terminal direction) (i) the IgV domain of CD58 (CD58-6), (ii) a linker, and (iii) a constant hIgG1 domain containing a T366W mutation for the knob to facilitate heterodimerization of the TBM as well as silencing mutations.

For the second TBM (shown schematically in FIG. 2B), a plasmid encoding a codon optimized anti-BCMA heavy chain was synthesized as a fusion comprising (in the N-terminal to C-terminal direction) (i) the AB3 VH domain fused to a constant hIgG1 CH1 domain (ii) a linker, (iii) the IgV domain of CD58 (CD58-6), (iv) a second linker, and (v) a hIgG1 Fc region containing T366S, L368A, and Y407V mutations for a hole to facilitate heterodimerization of the TBM as well as silencing mutations. A plasmid encoding a light chain was synthesized as a fusion comprising (in the N-terminal to C-terminal direction) the AB3 VL domain and the constant human lambda sequence. A plasmid encoding the second half antibody was synthesized as a fusion comprising (in the N-terminal to C-terminal direction) (i) an anti-TCR scFv corresponding to BMA031, (ii) a linker, and (iii) a constant hIgG1 domain containing a T366W mutation for the knob to facilitate heterodimerization of the TBM as well as silencing mutations.

Architectural antibody controls were also produced to allow assessment of the impact of geometry of the anti-BCMA and anti-CD3 ABMs on functional activity. A construct corresponding to AB3_TCR-CD58 in which the CD2 ABM was replaced with a Vhh against hen egg lysozyme (AB3_TCR-HEL) was produced. A one arm antibody (OAA) corresponding to AB3_TCR-CD58, but having no CD2 ABM, and the corresponding bispecific antibody having the BCMA ABM and CD3 ABMs on separate half antibodies (BSP), were also produced.

Amino acid sequences for components of the TBMs are shown in Table 19-A (without Fc sequences) and Table 19-B (with Fc sequences).

TABLE 19-A

| | | TBM amino acid sequences | |
|---|---|---|---|
| Construct Name | Chain Description | Amino Acid Sequence | SEQ ID NO: |
| AB3_TCR-CD58 | First Half Antibody Heavy Chain (Fc sequence not shown) | QVQLVESGGGWVQPGRSLRLSCAASGFTVSSYGMHWWRQA PGKGLEWVAVISYTGSNKYYADSVKGRFTISRDNSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSVVTVPSSSLGTQTYI CNVNHKPSNTKVDKRVEPKSCGGGGSGGGGSEVQLQQSG PELVKPGASVKMSCKASGYKFTSYVMHWVKQKPGQGLEWI GYINPYNDVTKYNEKFKGKATLTSDKSSSTAYMELSSLTSED SAVHYCARGSYYDYDGFVYWGQGTLVTVSAGGGGSGGGG SGGGGSGGGGSQIVLTQSPAIMSASPGEKVTMTCSATSSVS YMHWYQQKSGTSPKRWIYDTSKLASGVPARFSGSGSGTSY SLTISSMEAEDAATYYCQQWSSNPLTFGAGTKLELKGGGGS | 556 |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (Fc sequence not shown) | SQQIYGVYGNVTFHVPSNVPLKEVLWKKQKDKVAELENSE FRAFSSFKNRVYLDTVSGSLTIYNLTSSDEDEYEMESPNITDT MKFFLYVLESGGGGS | 558 |
| AB3_CD58 TCR | First Half Antibody Heavy Chain (Fc sequence not shown) | QVQLVESGGGWQPGRSLRLSCAASGFTVSSYGMHWVRQA PGKGLEWWAVISYTGSNKYYADSVKGRFTISRDNSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSWTVPSSSLGTQTYI CNVNHKPSNTKVDKRVEPKSCGGGGSGGGGSSQQIYGWY GNVTFHVPSNVPLKEVLWKKQKDKVAELENSEFRAFSSFKN RVYLDTVSGSLTIYNLTSSDEDEYEMESPNITDTMKFFLYVLE SGGGGS | 559 |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (Fc sequence not shown) | EVQLQQSGPELVKPGASVKMSCKASGYKFTSYVMHWVKQK PGQGLEWIGYINPYNDVTKYNEKFKGKATLTSDKSSSTAYME LSSLTSEDSAVHYCARGSYYDYDGFVYWGQGTLVTVSAGG GGSGGGGSGGGGSGGGGSQIVLTQSPAIMSASPGEKVTMT CSATSSVSYMHWYQQKSGTSPKRWIYDTSKLASGVPARFS GSGSGTSYSLTISSMEAEDAATYYCQQWSSNPLTFGAGTKL ELKGGGGS | 560 |
| AB3_TCR-HEL | First Half Antibody Heavy Chain (Fc sequence not shown) | QVQLVESGGGWQPGRSLRLSCAASGFTVSSYGMHWVRQA PGKGLEWVAVISYTGSNKYYADSVKGRFTISRDNSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSVVTVPSSSLGTQTYI CNVNHKPSNTKVDKRVEPKSCGGGGSGGGGSEVQLQQSG PELVKPGASVKMSCKASGYKFTSYVMHWVKQKPGQGLEWI GYINPYNDVTKYNEKFKGKATLTSDKSSSTAYMELSSLTSED SAVHYCARGSYYDYDGFVYWGQGTLVTVSAGGGGSGGGG SGGGGSGGGGSQIVLTQSPAIMSASPGEKVTMTCSATSSVS YMHWYQQKSGTSPKRWIYDTSKLASGVPARFSGSGSGTSY SLTISSMEAEDAATYYCQQWSSNPLTFGAGTKLELKGGGGS | 556 |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (Fc sequence not shown) | DVQLQASGGGSVQAGGSLRLSCAASGYTIGPYCMGWFRQA PGKEREGVAAINMGGGITYYADSVKGRFTISQDNAKNTVYLL MNSLEPEDTAIYYCAADSTIYASYYECGHGLSTGGYGYDSW GQGTQVTVSSGGGGS | 561 |

TABLE 19-B

| Construct Name | Chain Description | Amino Acid Sequence | SEQ ID NO: |
|---|---|---|---|
| | | TBM amino acid sequences | |
| AB3_TCR-CD58 | First Half Antibody Heavy Chain (includes Fc sequence) | QVQLVESGGGWVQPGRSLRLSCAASGFTVSSYGMHWWRQA PGKGLEWVAVISYTGSNKYYADSVKGRFTISRDNSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSVVTVPSSSLGTQTYI CNVNHKPSNTKVDKRVEPKSCGGGGSGGGGSEVQLQQSG PELVKPGASVKMSCKASGYKFTSYVMHWVKQKPGQGLEWI GYINPYNDVTKYNEKFKGKATLTSDKSSSTAYMELSSLTSED SAVHYCARGSYYDYDGFVYWGQGTLVTVSAGGGGSGGGG SGGGGSGGGGSQIVLTQSPAIMSASPGEKVTMTCSATSSVS YMHWYQQKSGTSPKRWIYDTSKLASGVPARFSGSGSGTSY SLTISSMEAEDAATYYCQQWSSNPLTFGAGTKLELKGGGGS DKTHTCPPCPAPELLGGPSVFLFPPKPKDTLMISRTPEVTCV VVAVSHEDPEVKFNWYVDGVEVHNAKTKPREEQYASTYRVV SVLTVLHQDWLNGKEYKCKVSNKALAAPIEKTISKAKGQPRE PQVCTLPPSREEMTKNQVSLSCAVKGFYPSDIAVEWESNGQ PENNYKTTPPVLDSDGSFFLVSKLTVDKSRWQQGNVFSCSV MHEALHNHYTQKSLSLSPGK | 862 |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (includes Fc sequence) | SQQIYGWYGNVTFHVPSNVPLKEVLWKKQKDKVAELENSE FRAFSSFKNRVYLDTVSGSLTIYNLTSSDEDEYEMESPNITDT MKFFLYVLESGGGGSDKTHTCPPCPAPELLGGPSVFLFPPK PKDTLMISRTPEVTQWWVAVSHEDPEVKFNWYVDGVEVHNA KTKPREEQYASTYRVVSVLTVLHQDWL.NGKEYKCKVSNKAL AAPIEKTISKAKGQPREPQVYTLPPQREEMTKNQVSLWCLVK GFYPSDIAVEWESNGQPENNYKTTPPVLDSDGSFFLYSKLTV DKSRWQQGNVFSCSVMHEALHNRYTQKSLSLSPGK | 863 |
| AB3_CD58 TCR | First Half Antibody Heavy Chain (includes Fc sequence) | QVQLVESGGGWQPGRSLRLSCAASGFTVSSYGMHWWRQA PGKGLEWWAVISYTGSNKYYADSVKGRFTISRONSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSWTVPSSSLGTQTYI CNVNHKPSNTKVDKRVEPKSCGGGGSGGGGSSQQIYGVY GNVTFHVPSNVPLKEVLWKKQKDKVAELENSEFRAFSSFKN RVYLDTVSGSLTIYNLTSSDEDEYEMESPNITDTMKFFLYVLE SGGGGSDKTHTCPPCPAPELLGGPSVFLFPPKPKDTLMISRT PEWCVWAVSHEDPEVKFNWYVDGVEVHNAKTKPREEQYA STYRWSVLTVLHQDWLNGKEYKCKVSNKALAAPIEKTISKAK GQPREPQVCTLPPSREEMTKNQVSLSCAVKGFYPSDIAVEW ESNGQPENNYKTTPPVLDSDGSFFLVSKLTVDKSRWQQGNV FSCSVMHEALHNHYTQKSLSLSPGK | 864 |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (includes Fc sequence) | EVQLQQSGPELVKPGASVKMSCKASGYKFTSYVMHWVKQK PGQGLEWIGYINPYNDVTKYNEKFKGKATLTSDKSSSTAYME LSSLTSEDSAVHYCARGSYYDYDGFVYWGQGTLVTVSAGG GGSGGGGSGGGGSGGGGSQIVLTQSPAIMSASPGEKVTMT CSATSSVSYMHWYQQKSGTSPKRWIYDTSKLASGVPARFS GSGSGTSYSLTISSMEAEDAATYYCQQWSSNPLTFGAGTKL ELKGGGGSDKTHTCPPCPAPELLGGPSVFLFPPKPKDTLMIS RTPEVTCVVVAVSHEDPEVKFNWYVDGVEVHNAKTKPREEQ YASTYRVVSVLTVLHQDWLNGKEYKCKVSNKALAAPIEKTISK AKGQPREPQVYTLPPCREEMTKNQVSLWCLVKGFYPSDIAV EWESNGQPENNYKTTPPVLDSDGSFFLYSKLTVDKSRWQQ GNVFSCSVMHEALHNRYTQKSLSLSPGK | 865 |
| AB3_TCR-HEL | First Half Antibody Heavy Chain (includes Fc sequence) | QVQLVESGGGWVQPGRSLRLSCAASGFTVSSYGMHWWRQA PGKGLEWVAVISYTGSNKYYADSVKGRFTISRDNSKNTLYLQ MNSLRAEDTAVYYCGGSGYALHDDYYGLDVWGQGTLVTVS SASTKGPSVFPLAPSSKSTSGGTAALGCLVKDYFPEPVTVS WNSGALTSGVHTFPAVLQSSGLYSLSSVVTVPSSSLGTQTYI CNVNHKPSNTKVDKRVEPKSCGGGGSGGGGSEVQLQQSG PELVKPGASVKMSCKASGYKFTSYVMHWVKQKPGQGLEWI GYINPYNDVTKYNEKFKGKATLTSDKSSSTAYMELSSLTSED SAVHYCARGSYYDYDGFVYWGQGTLVTVSAGGGGSGGGG | 862 |

TABLE 19-B-continued

TBM amino acid sequences

| Construct Name | Chain Description | Amino Acid Sequence | SEQ ID NO: |
|---|---|---|---|
| | | SGGGGSGGGGSQIVLTQSPAIMSASPGEKVTMTCSATSSVS YMHWYQQKSGTSPKRWIYDTSKLASGVPARFSGSGSGTSY SLTISSMEAEDAATYYCQQWSSNPLTFGAGTKLELKGGGGS DKTHTCPPCPAPELLGGPSVFLFPPKPKDTLMISRTPEVTCV VVAVSHEDPEVKFNWYVDGVEVHNAKTKPREEQYASTYRVV SVLTVLHQDWLNGKEYKCKVSNKALAAPIEKTISKAKGQPRE PQVCTLPPSREEMTKNQVSLSCAVKGFYPSDIAVEWESNGQ PENNYKTTPPVLDSDGSFFLVSKLTVDKSRWQQGNVFSCSV MHEALHNHYTQKSLSLSPGK | |
| | First Half Antibody Light Chain | QSALTQPASVSGSPGQSITISCTGTSSDVGGYNYVSWYQQH PGKAPKLMIYDVSNRLRGVSNRFSGSKSGNTASLTISGLQAE DEADYYCSSYTSSSALYVFGSGTKVTVLGQPKAAPSVTLFPP SSEELQANKATLVCLISDFYPGAVTVAWKADSSPVKAGVETT TPSKQSNNKYAASSYLSLTPEQWKSHRSYSCQVTHEGSTVE KTVAPTECS | 557 |
| | Second Half Antibody (includes Fc sequence) | DVQLQASGGGSVQAGGSLRLSCAASGYTIGPYCMGWFRQA PGKEREGVAAINMGGGITYYADSVKGRFTISQDNAKNTVYLL MNSLEPEDTAIYYCAADSTIYASYYECGHGLSTGGYGYDSW GQGTQVTVSSGGGGSDKTHTCPPCPAPELLGGPSVFLFPPK PKDTLMISRTPEVTCVWAVSHEDPEVKFNWYVDGVEVHNA KTKPREEQYASTYRVSVLTVLHQDWLNGKEYKCKVSNKAL AAPIEKTISKAKGQPREPQVYTLPPCREEMTKNQVSLWCLVK GFYPSDIAVEWESNGQPENNYKTTPPVLDSDGSFFLYSKLTV DKSRWQQGNVFSCSVMHEALHNRYTQKSLSLSPGK | 866 |

8.2.1.2. Expression and Purification

TBMs were expressed transiently by co-transfection of the respective chains in HEK293 cells. Briefly, transfection of the cells with the heavy and light chain plasmids was performed using PEI as transfection reagent with a final DNA:PEI ratio of 1:3. 1 mg of plasmid per liter of culture was used for transfection of cultures having 2.0 million cells/mL of serum media. After 5 days of expression, TBMs were harvested by clarification of the media via centrifugation and filtration. Purification was performed via anti-CH1 affinity batch binding (CaptureSelect IgG-CH1 Affinity Matrix, Thermo-Fisher Scientific, Waltham, MA, USA) or Protein A (rProteinA Sepharose, Fast flow, GE Healthcare, Uppsala, Sweden) batch binding using 1 ml resin, 100 mL supernatant. The protein was allowed to bind for a minimum of 2 hours with gentle mixing, and the supernatant loaded onto a gravity filtration column. The resin was washed with 20-50 CV of PBS. TBMs were eluted with 20 CV of 50 mM citrate, 90 mM NaCl pH 3.2. 50 mM sucrose. The eluted TBM fractions were adjusted to pH 5.5 with 1 M sodium citrate 50 mM sucrose. Preparative size exclusion chromatography was performed using Hi Load 16/60 Superdex 200 grade column (GE Healthcare Life Sciences, Uppsala, Sweden) as a final polishing step when aggregates were present. To confirm that the identity of the proteins of the TBMs expressed matched the predicted masses for the primary amino acid sequences, proteins were analyzed by high-performance liquid chromatography coupled to mass spectrometry.

Bispecific constructs were similarly expressed and purified.

8.2.1.3. RTCC Assay

Trispecific and bispecific constructs were evaluated for their potential to induce T cell-mediated apoptosis in tumor target cells. Briefly, huBCMA-expressing KMS11 target cells were engineered to overexpress firefly luciferase. Cells were harvested and resuspendend in RPMI medium (Invitrogen #11875-093) with 10% FBS. 2,500 target cells per well were plated in a flat-bottom 384-well plate. Human pan T effector cells were isolated via negative selection (Stemcell Technologies #17951) from cryopreserved PBMCs that were separated from a leukopak (Hemacare #PB001F-1) by Ficoll density gradient centrifugation. Purified T cells were then added to the plate to obtain a final E:T ratio of 5:1, 3:1, 1:1, 1:3 or 1:5. Co-cultured cells were incubated with a serial dilution of all constructs and controls. For normalization, average maximum luminescence refers to target cells co-incubated with effector cells, but without any test construct. After an incubation of 48 hours at 37° C., 5% $CO_2$, OneGlo luciferase substrate (Promega #E6120) was added to the plate. Luminescence was measured on an Envision plate reader after a 10 minute incubation. Percent specific lysis was calculated using the following equation:

$$\text{Specific lysis (\%)}=(1-(\text{sample luminescence/average maximum luminescence}))*100$$

8.2.1.4. Cytokine Release Assay

Trispecific constructs were analyzed for their ability to induce T cell-mediated de novo secretion of cytokines in the presence of tumor target cells. Briefly, huBCMA-expressing KMS11 target cells were engineered to overexpress firefly luciferase. Cells were harvested and resuspendend in RPMI medium (Invitrogen #11875-093) with 10% FBS. 10,000 target cells per well were plated in a flat-bottom 96-well plate. Human pan T effector cells were isolated via negative selection (Stemcell Technologies #17951) from cryopreserved PBMCs that were separated from a leukopak (Hemacare #PB001F-1) by Ficoll density gradient centrifugation. Purified T cells were then added to the plate to obtain a final E:T ratio of either 5:1, 1:1, or 1:5. Co-cultured cells were incubated with a serial dilution of all constructs and controls. After an incubation of 24 hours at 37° C., 5% $CO_2$ the supernatants were harvested by centrifugation at 300×g for 5 min for subsequent analysis. A multiplexed ELISA was performed according to the manufacturer's instructions using a V-PLEX Proinflammatory Panel 1 Kit (MesoScale Discovery #K15049D).

8.2.2. Results

RTCC data is shown in FIGS. 3A-E and cytokine levels are shown in FIGS. 4A-C. Each of the constructs was active in the RTCC assay.

8.3. Example 3: Production and Characterization of TBMs Binding BCMA, CD3, and CD2

TBMs targeting BCMA, CD3, and CD2 in a knob-into-hole (KIH) format are produced and characterized according to the Materials and Methods described in Example 2, except that the TCR ABMs of the constructs of Example 2 are replaced with sequences for CD3 binders as shown in Table 20-A (without Fc sequences) and Table 20-B (with Fc sequences).

TABLE 20-A

| | | TBM amino acid sequences | |
|---|---|---|---|
| TBM Name | Chain Description | Amino Acid Sequence | SEQ ID NO: |
| BCMA_AB3_CD3-16nM-CD58 | First Half Antibody Heavy Chain (Fc sequence not shown) | QVQLVESGGGVVQPGRSLRLSCAASGFTVSSYGMHWVRQ APGKGLEWVAVISYTGSNKYYADSVKGRFTISRDNSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKRVEPKSCGGGGSGGGGSEVQLV ESGGGLVQPGGSLKLSCAASGFTFNTYAMNWVRQASGKG LEWVGRIRSKYNNYATYYADSVKDRFTISRDDSKSTLYLQM NSLKTEDTAVYYCVRHGNFGNSYVSWFAYWGQGTLVTVSS GGGGSGGGGSGGGGSGGGGSQAWTQEPSLTVSPGGTV TLTCRSSTGAVTTSNYANWVQQKPGQAPRGLIGGTNKRAP WTPARFSGSLLGDKAALTLSGAQPEDEAEYFCALWYSNLW VFGGGTKLTVLGGGGS | 562 |
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDYFPGAVTVAWKADSSPVKAG VETTTPSKQSNNKYAASSYLSLTPEQWKSHRSYSCQVTHE GSTVEKTVAPTECS | 557 |
| | Second Half Antibody (Fc sequence not shown) | SQQIYGWYGNVTFHVPSNVPLKEVLWKKQKDKVAELENSE FRAFSSFKNRVYLDTVSGSLTIYNLTSSDEDEYEMESPNITD TMKFFLYVLESGGGGS | 558 |
| BCMA_AB3_CD58 CD3-16nM | First Half Antibody Heavy Chain (Fc sequence not shown) | QVQLVESGGGVVQPGRSLRLSCAASGFTVSSYGMHWVRQ APGKGLEWWAVISYTGSNKYYADSVKGRFTISRONSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSWTVPSSSLGT QTYICNVNHKPSNTKVDKRVEPKSCGGGGSGGGGSSQQIY GWYGNVTFHVPSNVPLKEVLWKKQKDKVAELENSEFRAF SSFKNRVYLDTVSGSLTIYNLTSSDEDEYEMESPNITDTMKF FLYVLESGGGGS | 559 |
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDYFPGAVTVAWKADSSPVKAG VETTTPSKQSNNKYAASSYLSLTPEQWKSHRSYSCQVTHE GSTVEKTVAPTECS | 557 |
| | Second Half Antibody (Fc sequence not shown) | EVQLVESGGGLVQPGGSLKLSCAASGFTFNTYAMNWVRQA SGKGLEWVGRIRSKYNNYATYYADSVKDRFTISRDDSKSTL YLQMNSLKTEDTAVYYCVRHGNFGNSYVSWFAYWGQGTL VTVSSGGGGSGGGGSGGGGSGGGGSQAVVTQEPSLTVS PGGTVTLTCRSSTGAVTTSNYANWVQQKPGQAPRGLIGGT NKRAPWTPARFSGSLLGDKAALTLSGAQPEDEAEYFCALW YSNLWVFGGGTKLTVLGGGGS | 563 |
| BCMA_AB3_CD3-16nM HEL | First Half Antibody Heavy Chain (Fc sequence not shown) | QVQLVESGGGVVQPGRSLRLSCAASGFTVSSYGMHWVRQ APGKGLEWVAVISYTGSNKYYADSVKGRFTISRDNSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKRVEPKSCGGGGSGGGGSEVQLV ESGGGLVQPGGSLKLSCAASGFTFNTYAMNWVRQASGKG LEWVGRIRSKYNNYATYYADSVKDRFTISRDDSKSTLYLQM NSLKTEDTAVYYCVRHGNFGNSYVSWFAYWGQGTLVTVSS GGGGSGGGGSGGGGSGGGGSQAWTQEPSLTVSPGGTV TLTCRSSTGAVTTSNYANWVQQKPGQAPRGLIGGTNKRAP WTPARFSGSLLGDKAALTLSGAQPEDEAEYFCALWYSNLW VFGGGTKLTVLGGGGS | 562 |

TABLE 20-A-continued

TBM amino acid sequences

| TBM Name | Chain Description | Amino Acid Sequence | SEQ ID NO: |
|---|---|---|---|
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDFYPGAVTVAWKADSSPVKAG VETTTPSKQSNNKYAASSYLSLTPEQWKSHRSYSCQVTHE GSTVEKTVAPTECS | 557 |
| | Second Half Antibody (Fc sequence not shown) | DVQLQASGGGSVQAGGSLRLSCAASGYTIGPYCMGWFRQ APGKEREGVAAINMGGGITYYADSVKGRFTISQDNAKNTVY LLMNSLEPEDTAIYYCAADSTIYASYYECGHGLSTGGYGYD SWGQGTQVTVSSGGGGS | 561 |

TABLE 20-B

TBM amino acid sequences

| TBM Name | Chain Description | Amino Acid Sequence | SEQ ID NO: |
|---|---|---|---|
| BCMA_AB3_ CD3- 16nM- CD58 | First Half Antibody Heavy Chain (includes Fc sequence) | QVQLVESGGGVVQPGRSLRLSCAASGFTVSSYGMHWVRQ APGKGLEWVAVISYTGSNKYYADSVKGRFTISRDNSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKRVEPKSCGGGGSGGGGSEVQLV ESGGGLVQPGGSLKLSCAASGFTFNTYAMNWVRQASGKG LEWVGRIRSKYNNYATYYADSVKDRFTISRDDSKSTLYLQM NSLKTEDTAVYYCVRHGNFGNSYVSWFAYWGQGTLVTVSS GGGGSGGGGSGGGGSGGGGSQAWTQEPSLTVSPGGTV TLTCRSSTGAVTTSNYANWVQQKPGQAPRGLIGGTNKRAP WTPARFSGSLLGDKAALTLSGAQPEDEAEYFCALWYSNLW VFGGGTKLTVLGGGGSDKTHTCPPCPAPELLGGPSVFLFPP KPKDTLMISRTPEVTCVVVAVSHEDPEVKFNWYVDGVEVHN AKTKPREEQYASTYRVVSVLTVLHQDWLNGKEYKCKVSNK ALAAPIEKTISKAKGQPREPQVCTLPPSREEMTKNQVSLSCA VKGFYPSDIAVEWESNGQPENNYKTTPPVLDSDGSFFLVSK LTVDKSRWQQGNVFSCSVMHEALHNHYTQKSLSLSPGK | 867 |
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDFYPGAVTVAWKADSSPVKAG VETTTPSKQSNNKYAASSYLSLTPEQWKSHRSYSCQVTHE GSTVEKTVAPTECS | 557 |
| | Second Half Antibody (includes Fc sequence) | SQQNYGWYGNVTFHVPSNVPLKEVLWKKQKDKVAELENSE FRAFSSFKNRVYLDTVSGSLTIYNLTSSDEDEYEMESPNITD TMKFFLYVLESGGGGSDKTHTCPPCPAPELLGGPSVFLFPP KPKDTLMISRTPEVTCVWVAVSHEDPEVKFNWYVDGVEVHN AKTKPREEQYASTYRWSVLTVLHQDWLNGKEYKCKVSNK ALAAPIEKTISKAKGQPREPQVYTLPPCREEMTKNQVSLWC LVKGFYPSDIAVEWESNGQPENNYKTTPPVLDSDGSFFLYS KLTVDKSRWQQGNVFSCSVMHEALHNRYTQKSLSLSPGK | 863 |
| BCMA_AB3_ CD58 CD3-16nM | First Half Antibody Heavy Chain (includes Fc sequence) | QVQLVESGGGWQPGRSLRLSCAASGFTVSSYGMHWWRQ APGKGLEWWAVISYTGSNKYYADSVKGRFTISRDNSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSWTVPSSSLGT QTYICNVNHKPSNTKVDKRVEPKSCGGGGSGGGGSSQQIY GWYGNVTFHVPSNVPLKEVLWKKQKDKVAELENSEFRAF SSFKNRVYLDTVSGSLTIYNLTSSDEDEYEMESPNITDTMKF FLYVLESGGGGSDKTHTCPPCPAPELLGGPSVFLFPPKPKD TLMISRTPEVTCVWAVSHEDPEVKFNWYVDGVEVHNAKTK PREEQYASTYRVSVLTVLHQDWLNGKEYKCKVSNKALAA PIEKTISKAKGQPREPQVCTLPPSREEMTKNQVSLSCAVKG FYPSDIAVEWESNGQPENNYKTTPPVLDSDGSFFLVSKLTV DKSRWQQGNVFSCSVMHEALHNHYTQKSLSLSPGK | 864 |
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDFYPGAVTVAWKADSSPVKAG VETTTPSKQSNNKYAASSYLSLTPEQWKSHRSYSCQVTHE GSTVEKTVAPTECS | 557 |

TABLE 20-B-continued

| | | TBM amino acid sequences | |
| TBM Name | Chain Description | Amino Acid Sequence | SEQ ID NO: |
| --- | --- | --- | --- |
| | Second Half Antibody (includes Fc sequence) | EVQLVESGGGLVQPGGSLKLSCAASGFTFNTYAMNWVRQA SGKGLEWVGRIRSKYNNYATYYADSVKDRFTISRDDSKSTL YLQMNSLKTEDTAVYYCVRHGNFGNSYVSWFAYWGQGTL VTVSSGGGGSGGGGSGGGGSGGGGSQAVVTQEPSLTVS PGGTVTLTCRSSTGAVTTSNYANWVQQKPGQAPRGLIGGT NKRAPWTPARFSGSLLGDKAALTLSGAQPEDEAEYFCALW YSNLWVFGGGTKLTVLGGGGSDKTHTCPPCPAPELLGGPS VFLFPPKPKDTLMISRTPEVTCVVVAVSHEDPEVKFNWYVD GVEVHNAKTKPREEQYASTYRWSVLTVLHQDWLNGKEYK CKVSNKALAAPIEKTISKAKGQPREPQVYTLPPCREEMTKN QVSLWCLVKGFYPSDIAVEWESNGQPENNYKTTPPVLDSD GSFFLYSKLTVDKSRWQQGNVFSCSVMHEALHNRYTQKSL SLSPGK | 868 |
| BCMA_AB3_ CD3- 16nM HEL | First Half Antibody Heavy Chain (includes Fc sequence) | QVQLVESGGGVVQPGRSLRLSCAASGFTVSSYGMHWVRQ APGKGLEWVAVISYTGSNKYYADSVKGRFTISRDNSKNTLY LQMNSLRAEDTAVYYCGGSGYALHDDYYGLDVWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKRVEPKSCGGGGSGGGGSEVQLV ESGGGLVQPGGSLKLSCAASGFTFNTYAMNWVRQASGKG LEWVGRIRSKYNNYATYYADSVKDRFTISRDDSKSTLYLQM NSLKTEDTAVYYCVRHGNFGNSYVSWFAYWGQGTLVTVSS GGGGSGGGGSGGGGSGGGGSQAWTQEPSLTVSPGGTV TLTCRSSTGAVTTSNYANWVQQKPGQAPRGLIGGTNKRAP WTPARFSGSLLGDKAALTLSGAQPEDEAEYFCALWYSNLW VFGGGTKLTVLGGGGSDKTHTCPPCPAPELLGGPSVFLFPP KPKDTLMISRTPEVTCVVVAVSHEDPEVKFNWYVDGVEVHN AKTKPREEQYASTYRVVSVLTVLHQDWLNGKEYKCKVSNK ALAAPIEKTISKAKGQPREPQVCTLPPSREEMTKNQVSLSCA VKGFYPSDIAVEWESNGQPENNYKTTPPVLDSDGSFFLVSK LTVDKSRWQQGNVFSCSVMHEALHNHYTQKSLSLSPGK | 867 |
| | First Half Antibody Light Chain | QSALTQPASVSGSPGQSITISCTGTSSDVGGYNYVSWYQQ HPGKAPKLMIYDVSNRLRGVSNRFSGSKSGNTASLTISGLQ AEDEADYYCSSYTSSSALYVFGSGTKVTVLGQPKAAPSVTL FPPSSEELQANKATLVCLISDFYPGAVTVAWKADSSPVKAG VETTTPSKQSNNKYAASSYLSLTPEQWKSHRSYSCQVTHE GSTVEKTVAPTECS | 557 |
| | Second Half Antibody (includes Fc sequence) | DVQLQASGGGSVQAGGSLRLSCAASGYTIGPYCMGWFRQ APGKEREGVAAINMGGGITYYADSVKGRFTISQDNAKNTVY LLMNSLEPEDTAIYYCAADSTIYASYYECGHGLSTGGYGYD SWGQGTQVTVSSGGGGSDKTHTCPPCPAPELLGGPSVFLF PPKPKDTLMISRTPEVTCVWAVSHEDPEVKFNWYVDGVEV HNAKTKPREEQYASTYRWSVLTVLHQDWLNGKEYKCKVS NKALAAPIEKTISKAKGQPREPQVYTLPPCREEMTKNQVSL WCLVKGFYPSDIAVEWESNGQPENNYKTTPPVLDSDGSFF LYSKLTVDKSRWQQGNVFSCSVMHEALHNRYTQKSLSLSP GK | 866 |

RTCC and cytokine release assays are performed as in Example 2. The trispecific constructs are active in the RTCC assay.

8.4. Example 4: Engineering CD58 for Improved Stability

8.4.1. Background

Human CD58 contains a signal peptide of 29 amino acids and two Ig-like domains. The most N-terminal Ig-like domain, referred to as domain 1, is of V-type, similar to a variable region of an antibody, and the second domain, named domain 2, is of C-type, is similar to a constant regions of an antibody. A schematic overview of the CD58 domain structure is shown in FIG. 5.

As illustrated in Example 2, domain 1 of CD58, which interacts with CD2, can be used in lieu of an anti-CD2 antibody binding fragment in multispecific binding molecules. However, CD58 exhibits lower stability than immunoglobulins.

In order to improve stability of human CD58 domain 1, the protein was engineered to include a pair of cysteine that form a disulfide bridge upon expression to stabilize the molecule.

Four different pairs of amino acids were engineered to be replaced by cysteines: (1) V45 and M105, (2) V45 and M114, (3) V54 and G88 and (4) W56 and L90.

8.4.2. Materials and Methods

8.4.2.1. Recombinant Expression

To assess the binding and biophysical characteristics, the CD58 disulfide variants were transiently produced and purified from HEK293 cells along with the CD2 extracellular domain. All plasmids were codon optimized for mammalian expression. Human and cyno CD2 constructs were produced with a C-terminal Avi-Tag and a N terminal 8×his tag (SEQ ID NO: 564) followed by a EVNLYFQS sequence (SEQ ID NO: 565) for cleavage of the histag after purification. CD2 constructs were site selectively biotinylated during expression via co-transfection of a plasmid encoding the BirA enzyme. CD58 was expressed with a C-terminal 8×his tag (SEQ ID NO: 564). Transient expression and purification in HEK293F cells was performed with standard methodology. The sequences are shown in Table 21.

TABLE 21

| Protein Name | AA Sequence | SEQ ID NO: |
|---|---|---|
| Human CD2 | SKEITNALETWGALGQDINLDIPSFQMSDDIDDIKWEKTS<br>DKKKIAQFRKEKETFKEKDTYKLFKNGTLKIKHLKTDDQ<br>DIYKVSIYDTKGKNVLEKIFDLKIQERVSKPKISWTCINTT<br>LTCEVMNGTDPELNLYQDGKHLKLSQRVITHKWTTSLS<br>AKFKCTAGNKVSKESSVEPVSCPEKGLDGGGGSGLNDI<br>FEAQKIEWHE | 566 |
| Cyno CD2 | SKEIRNALETWGALGQDIDLDIPSFQMSDDIDDIRWEKT<br>SDKKKIAQFRKEKETFEEKDAYKLFKNGTLKIKHLKIHDQ<br>DSYKVSIYDTKGKNVLEKTFDLKIQERVSEPKISWTCINT<br>TLTCEVMNGTDPELNLYQDGKHVKLSQRVITHKWTTSL<br>SAKFKCTAGNKVSKESRMETVSCPEKGLDGGGGSGLN<br>DIFEAQKIEWHE | 567 |
| CD58 Full ECD | SQQIYGVVYGNVTFHVPSNVPLKEVLWKKQKDKVAELE<br>NSEFRAFSSFKNRVYLDTVSGSLTIYNLTSSDEDEYEME<br>SPNITDTMKFFLYVLESLPSPTLTCALTNGSIEVQCMIPE<br>HYNSHRGLIMYSWDCPMEQCKRNSTSIYFKMENDLPQ<br>KIQCTLSNPLFNTTSSIILTTCIPSSGHSRHRGGGGSHHH<br>HHHHH | 568 |
| CD58_IgV | SQQIYGWYGNVTFHVPSNVPLKEVLWKKQKDKVAELE<br>NSEFRAFSSFKNRVYLDTVSGSLTIYNLTSSDEDEYEME<br>SPNITDTMKFFLYVLESGGGGSHHHHHHHH | 569 |
| IgV<br>V45C_M105C | SQQIYGWYGNVTFHCPSNVPLKEVLWKKQKDKVAELE<br>NSEFRAFSSFKNRVYLDTVSGSLTIYNLTSSDEDEYECE<br>SPNITDTMKFFLYVLESGGGGSHHHHHHHH | 570 |
| IgV<br>V54C_G88C | SQQIYGVVYGNVTFHVPSNVPLKECLWKKQKDKVAELE<br>NSEFRAFSSFKNRVYLDTVSCSLTIYNLTSSDEDEYEME<br>SPNITDTMKFFLYVLESGGGGSHHHHHHHH | 571 |
| IgV<br>V45C_M114C | SQQIYGVVYGNVTFHCPSNVPLKEVLWKKQKDKVAELE<br>NSEFRAFSSFKNRVYLDTVSGSLTIYNLTSSDEDEYEME<br>SPNITDTCKFFLYVLESGGGGSHHHHHHHH | 572 |

For expression, transfection was performed using PEI as transfection reagent. For small scale (<5 L) transfections, cells were grown in shake flasks on an orbital shaker (100 rpm) in a humidified incubator (85%) at 8% CO2). Transfection was done with a ratio of 1 DNA:3 PEI. 1 mg/L culture of plasmid was used for transfection at 2.0 million cells/mL in Expi293 medium. After 5 days of expression, the culture was centrifuged and filtrated. Purification was performed via Nickel-NTA batch binding using 1 ml resin, 100 mL supernatant. The protein was allowed to bind for a minimum of 2 hours with gentle mixing, and the mixture was loaded onto a gravity filtration column. The resin was washed with 30 CV of PBS. Proteins were eluted with imidazole. The eluted protein was concentrated and finally purified via a preparative size exclusion chromatography (Hi Load 16/60 Superdex 75 grade column, GE Healthcare Life Sciences, Uppsala, Sweden). To confirm that the identity of the proteins expressed matched the predicted masses for the primary amino acid sequences, proteins were analyzed by high-performance liquid chromatography coupled to mass spectrometry.

8.4.2.2. Stability

Disulfide stabilized variants were assessed for improved thermal stability using both differential scanning calorimetry (DSC) and differential scanning fluorimetry (DSF) using standard techniques. For DSF, 1-3 ug of each construct was add to 1× Sypro Orange (Thermo-Fisher) in 25 ul total volume in 96-well PCR plate. Using a Bio-Rad CFX96 RT-PCR system equipped with C1000 Thermal Cycler, the temperature was increased from 25° C. to 95° C. at 0.5° C./minute and the fluorescence monitored. The manufacturer-supplied software was used to determine Tm.

For DSC, all samples were dialyzed into HEPES-buffered saline (HBS) and diluted to final concentration of 0.5 mg/mL. Tm and Tonset were determined using a MicroCal VP-Capillary DSC system (Malvern) by increasing temperature from 25° C. to 100° C. at 1° C./minute with a filtering period of 2 seconds and a mid-gain setting.

8.4.2.3. Binding Affinity

To ensure the binding affinity remained uncompromised by the additional of the stabilizing disulfide variance, isothermal calorimetry (ITC) was performed on the resulting recombinant CD58 proteins to determine their apparent KD and binding stoicheometry (n) to recombinant human CD2.

Briefly, recombinant human CD2 and recombinant human CD58 variants were dialyzed into HEPES-buffered saline (HBS). CD2 was diluted to final concentration of 100 μM, CD58 variants were diluted to 10 μM. CD2 was titrated into 10 μM of CD58 variants via multiple injections and ΔH (kcal/mole) determined using a MicroCal VP-ITC isothermal titration calorimeter (Malvern). Titrations of CD2 into HBS were used as a reference and KD and n determined from the resulting data.

8.4.3. Results

Results for both DSF and DSC measurements for the constructs are shown in Table 22 below.

TABLE 22

| CD58 variant | By Differential Scanning Fluorimetry (DSF) Tm (° C.) | By Differential Scanning Calorimetry (DSC) | |
|---|---|---|---|
| | | Tmonset (° C.) | Tm (° C.) |
| CD58 Full ECD | 59.5 | 48.8 | 65.0 |
| CD58_IgV | 48.5 | 46.3 | 60.9 |
| IgV V45C_M105C | 48.5 | 43.9 | 66.8 |
| IgV V54C_G88C | 76.5 | 66.7 | 80.9 |
| IgV V45C_M114C | 63.5 | 49.6 | 72.5 |

Results of the affinity studies are shown in Table 23 below. Addition of stabilizing disulfide had no detrimental impact on the affinity or the binding stoicheometry.

TABLE 23

| CD58 variant | KD (uM) | n |
|---|---|---|
| CD58 Full ECD | 0.57 (±0.05) | 0.92 (±0.01) |
| CD58_IgV | 0.61 (±0.07) | 0.96 (±0.01) |
| IgV V45C_M105C | 0.88 (±0.06) | 0.97 (±0.01) |
| IgV V54C_G88C | 0.60 (±0.06) | 0.83 (±.0.01) |
| IgV V45C_M114C | 0.38 (±0.03) | 0.88 (±.0.01) |

9. SPECIFIC EMBODIMENTS, CITATION OF REFERENCES

While various specific embodiments have been illustrated and described, it will be appreciated that various changes can be made without departing from the spirit and scope of the disclosure(s). The present disclosure is exemplified by the numbered embodiments set forth below.

1. A multispecific binding molecule (MBM), comprising:
(a) an antigen-binding module 1 (ABM1) that binds specifically to human BCMA and comprises CDR-L1, CDR-L2 and CDR-L3 sequences set forth in Table 11A-1, Table 11B-1, Table 11C-1, Table 11D-1, Table 11E-1, Table 11F-1, Table 11G-1, Table 11H-1, Table 11I-1, Table 11J-1, Table 11K-1(a), Table 11K-1(b), Table 11L-1, Table 11M-1, Table 11N-1(a), or Table 11N-1(b), and the corresponding CDR-H1, CDR-H2 and CDR-H3 sequence set forth in Table 11A-2, Table 11B-2, Table 11C-2, Table 11D-2, Table 11E-2, Table 11F-2, Table 11G-2, Table 11H-2, Table 11I-2, Table 11J-2, Table 11K-2, Table 11K-2, Table 11L-2, Table 11M-2, Table 11N-2, or Table 11N-2, respectively;
(b) an antigen-binding module 2 (ABM2) that binds specifically to a component of a human T-cell receptor (TCR) complex; and
(c) an antigen-binding module 3 (ABM3) that binds specifically to human CD2 or a human tumor-associated antigen (TAA).

2. The MBM of embodiment 1, wherein ABM1 comprises CDR-L1, CDR-L2 and CDR-L3 sequences set forth in Table 11A-1, Table 11B-1, Table 11C-1, Table 11D-1, Table 11E-1, Table 11F-1, Table 11G-1, Table 11H-1, Table 11I-1, Table 11J-1, Table 11K-1(a), Table 11L-1, Table 11M-1, or Table 11N-1(a), and the corresponding CDR-H1, CDR-H2 and CDR-H3 sequence set forth in Table 11A-2, Table 11B-2, Table 11C-2, Table 11D-2, Table 11E-2, Table 11F-2, Table 11G-2, Table 11H-2, Table 11I-2, Table 11J-2, Table 11K-2, Table 11L-2, Table 11M-2, or Table 11N-2, respectively.

3. The MBM of embodiment 1 or embodiment 2, wherein ABM1 comprises CDR-L1, CDR-L2 and CDR-L3 sequences set forth in Table 11A-1 and the corresponding CDR-H1, CDR-H2 and CDR-H3 sequence set forth in Table 11A-2.

4. The MBM of embodiment 1 or embodiment 2, wherein ABM1 comprises CDR-L1, CDR-L2 and CDR-L3 sequences set forth in Table 11B-1 and the corresponding CDR-H1, CDR-H2 and CDR-H3 sequence set forth in Table 11B-2.

5. The MBM of embodiment 1 or embodiment 2, wherein ABM1 comprises CDR-L1, CDR-L2 and CDR-L3 sequences set forth in Table 11C-1 and the corresponding CDR-H1, CDR-H2 and CDR-H3 sequence set forth in Table 11C-2.

6. The MBM of embodiment 1 or embodiment 2, wherein ABM1 comprises CDR-L1, CDR-L2 and CDR-L3 sequences set forth in Table 11D-1 and the corresponding CDR-H1, CDR-H2 and CDR-H3 sequence set forth in Table 11D-2.

7. The MBM of embodiment 1 or embodiment 2, wherein ABM1 comprises CDR-L1, CDR-L2 and CDR-L3 sequences set forth in Table 11E-1 and the corresponding CDR-H1, CDR-H2 and CDR-H3 sequence set forth in Table 11E-2.

8. The MBM of embodiment 1 or embodiment 2, wherein ABM1 comprises CDR-L1, CDR-L2 and CDR-L3 sequences set forth in Table 11F-1 and the corresponding CDR-H1, CDR-H2 and CDR-H3 sequence set forth in Table 11F-2.

9. The MBM of embodiment 1 or embodiment 2, wherein ABM1 comprises CDR-L1, CDR-L2 and CDR-L3 sequences set forth in Table 11G-1 and the corresponding CDR-H1, CDR-H2 and CDR-H3 sequence set forth in Table 11G-2.

10. The MBM of embodiment 1 or embodiment 2, wherein ABM1 comprises CDR-L1, CDR-L2 and CDR-L3 sequences set forth in Table 11H-1 and the corresponding CDR-H1, CDR-H2 and CDR-H3 sequence set forth in Table 11H-2.

11. The MBM of embodiment 1 or embodiment 2, wherein ABM1 comprises CDR-L1, CDR-L2 and CDR-L3 sequences set forth in Table 11I-1 and the corresponding CDR-H1, CDR-H2 and CDR-H3 sequence set forth in Table 11I-2.

12. The MBM of embodiment 1 or embodiment 2, wherein ABM1 comprises CDR-L1, CDR-L2 and CDR-L3 sequences set forth in Table 11J-1 and the corresponding CDR-H1, CDR-H2 and CDR-H3 sequence set forth in Table 11J-2.

13. The MBM of embodiment 1 or embodiment 2, wherein ABM1 comprises CDR-L1, CDR-L2 and CDR-L3 sequences set forth in Table 11K-1(a) and the corresponding CDR-H1, CDR-H2 and CDR-H3 sequence set forth in Table 11K-2.

14. The MBM of embodiment 1, wherein ABM1 comprises CDR-L1, CDR-L2 and CDR-L3 sequences set forth in Table 11K-1(b) and the corresponding CDR-H1, CDR-H2 and CDR-H3 sequence set forth in Table 11K-2.

15. The MBM of embodiment 1 or embodiment 2, wherein ABM1 comprises CDR-L1, CDR-L2 and CDR-L3 sequences set forth in Table 11L-1 and the corresponding CDR-H1, CDR-H2 and CDR-H3 sequence set forth in Table 11L-2.

16. The MBM of embodiment 1 or embodiment 2, wherein ABM1 comprises CDR-L1, CDR-L2 and CDR-L3 sequences set forth in Table 11M-1 and the corresponding CDR-H1, CDR-H2 and CDR-H3 sequence set forth in Table 11M-2.

17. The MBM of embodiment 1 or embodiment 2, wherein ABM1 comprises CDR-L1, CDR-L2 and CDR-L3 sequences set forth in Table 11N-1(a) and the corresponding CDR-H1, CDR-H2 and CDR-H3 sequence set forth in Table 11N-2.

18. The MBM of embodiment 1, wherein ABM1 comprises CDR-L1, CDR-L2 and CDR-L3 sequences set forth in Table 11N-1(b) and the corresponding CDR-H1, CDR-H2 and CDR-H3 sequence set forth in Table 11N-2.

19. The MBM of embodiment 3, wherein the CDR-L1, CDR-L2, CDR-L3, CDR-H1, CDR-H2 and CDR-H3 sequences are those of C1.

20. The MBM of embodiment 3, wherein the CDR-L1, CDR-L2, CDR-L3, CDR-H1, CDR-H2 and CDR-H3 sequences are those of C2.

21. The MBM of embodiment 3, wherein the CDR-L1, CDR-L2, CDR-L3, CDR-H1, CDR-H2 and CDR-H3 sequences are those of C3.

22. The MBM of embodiment 3, wherein the CDR-L1, CDR-L2, CDR-L3, CDR-H1, CDR-H2 and CDR-H3 sequences are those of C4.

23. The MBM of embodiment 3, wherein the CDR-L1, CDR-L2, CDR-L3, CDR-H1, CDR-H2 and CDR-H3 sequences are those of C5.

24. The MBM of embodiment 3, wherein the CDR-L1, CDR-L2, CDR-L3, CDR-H1, CDR-H2 and CDR-H3 sequences are those of C6.

25. The MBM of embodiment 3, wherein the CDR-L1, CDR-L2, CDR-L3, CDR-H1, CDR-H2 and CDR-H3 sequences are those of C7.

26. The MBM of embodiment 3, wherein the CDR-L1, CDR-L2, CDR-L3, CDR-H1, CDR-H2 and CDR-H3 sequences are those of C8.

27. The MBM of embodiment 3, wherein the CDR-L1, CDR-L2, CDR-L3, CDR-H1, CDR-H2 and CDR-H3 sequences are those of C9.

28. The MBM of embodiment 3, wherein the CDR-L1, CDR-L2, CDR-L3, CDR-H1, CDR-H2 and CDR-H3 sequences are those of C10.

29. The MBM of embodiment 3, wherein the CDR-L1, CDR-L2, CDR-L3, CDR-H1, CDR-H2 and CDR-H3 sequences are those of C11.

30. The MBM of embodiment 3, wherein the CDR-L1, CDR-L2, CDR-L3, CDR-H1, CDR-H2 and CDR-H3 sequences are those of C12.

31. The MBM of embodiment 4, wherein the CDR-L1, CDR-L2, CDR-L3, CDR-H1, CDR-H2 and CDR-H3 sequences are those of C13.

32. The MBM of embodiment 4, wherein the CDR-L1, CDR-L2, CDR-L3, CDR-H1, CDR-H2 and CDR-H3 sequences are those of C14.

33. The MBM of embodiment 4, wherein the CDR-L1, CDR-L2, CDR-L3, CDR-H1, CDR-H2 and CDR-H3 sequences are those of C15.

34. The MBM of embodiment 4, wherein the CDR-L1, CDR-L2, CDR-L3, CDR-H1, CDR-H2 and CDR-H3 sequences are those of C16.

35. The MBM of embodiment 4, wherein the CDR-L1, CDR-L2, CDR-L3, CDR-H1, CDR-H2 and CDR-H3 sequences are those of C17.

36. The MBM of embodiment 4, wherein the CDR-L1, CDR-L2, CDR-L3, CDR-H1, CDR-H2 and CDR-H3 sequences are those of C18.

37. The MBM of embodiment 4, wherein the CDR-L1, CDR-L2, CDR-L3, CDR-H1, CDR-H2 and CDR-H3 sequences are those of C19.

38. The MBM of embodiment 4, wherein the CDR-L1, CDR-L2, CDR-L3, CDR-H1, CDR-H2 and CDR-H3 sequences are those of C20.

39. The MBM of embodiment 4, wherein the CDR-L1, CDR-L2, CDR-L3, CDR-H1, CDR-H2 and CDR-H3 sequences are those of C21.

40. The MBM of embodiment 4, wherein the CDR-L1, CDR-L2, CDR-L3, CDR-H1, CDR-H2 and CDR-H3 sequences are those of C22.

41. The MBM of embodiment 4, wherein the CDR-L1, CDR-L2, CDR-L3, CDR-H1, CDR-H2 and CDR-H3 sequences are those of C23.

42. The MBM of embodiment 4, wherein the CDR-L1, CDR-L2, CDR-L3, CDR-H1, CDR-H2 and CDR-H3 sequences are those of C24.

43. The MBM of embodiment 4, wherein the CDR-L1, CDR-L2, CDR-L3, CDR-H1, CDR-H2 and CDR-H3 sequences are those of C25.

44. The MBM of embodiment 4, wherein the CDR-L1, CDR-L2, CDR-L3, CDR-H1, CDR-H2 and CDR-H3 sequences are those of C26.

45. The MBM of embodiment 4, wherein the CDR-L1, CDR-L2, CDR-L3, CDR-H1, CDR-H2 and CDR-H3 sequences are those of C27.

46. The MBM of embodiment 4, wherein the CDR-L1, CDR-L2, CDR-L3, CDR-H1, CDR-H2 and CDR-H3 sequences are those of C28.

47. The MBM of any one of embodiments 5 to 10, wherein the CDR-L1, CDR-L2, CDR-L3, CDR-H1, CDR-H2 and CDR-H3 sequences are those of AB1.

48. The MBM of any one of embodiments 5 to 10, wherein the CDR-L1, CDR-L2, CDR-L3, CDR-H1, CDR-H2 and CDR-H3 sequences are those of AB2.

49. The MBM of any one of embodiments 5 to 10, wherein the CDR-L1, CDR-L2, CDR-L3, CDR-H1, CDR-H2 and CDR-H3 sequences are those of R1F2.

50. The MBM of any one of embodiments 5 to 10, wherein the CDR-L1, CDR-L2, CDR-L3, CDR-H1, CDR-H2 and CDR-H3 sequences are those of PALF03.

51. The MBM of any one of embodiments 5 to 10, wherein the CDR-L1, CDR-L2, CDR-L3, CDR-H1, CDR-H2 and CDR-H3 sequences are those of PALF04.

52. The MBM of any one of embodiments 5 to 10, wherein the CDR-L1, CDR-L2, CDR-L3, CDR-H1, CDR-H2 and CDR-H3 sequences are those of PALF05.

53. The MBM of any one of embodiments 5 to 10, wherein the CDR-L1, CDR-L2, CDR-L3, CDR-H1, CDR-H2 and CDR-H3 sequences are those of PALF06.

54. The MBM of any one of embodiments 5 to 10, wherein the CDR-L1, CDR-L2, CDR-L3, CDR-H1, CDR-H2 and CDR-H3 sequences are those of PALF07.

55. The MBM of any one of embodiments 5 to 10, wherein the CDR-L1, CDR-L2, CDR-L3, CDR-H1, CDR-H2 and CDR-H3 sequences are those of PALF08.

56. The MBM of any one of embodiments 5 to 10, wherein the CDR-L1, CDR-L2, CDR-L3, CDR-H1, CDR-H2 and CDR-H3 sequences are those of PALF09.

57. The MBM of any one of embodiments 5 to 10, wherein the CDR-L1, CDR-L2, CDR-L3, CDR-H1, CDR-H2 and CDR-H3 sequences are those of PALF12.

58. The MBM of any one of embodiments 5 to 10, wherein the CDR-L1, CDR-L2, CDR-L3, CDR-H1, CDR-H2 and CDR-H3 sequences are those of PALF13.

59. The MBM of any one of embodiments 5 to 10, wherein the CDR-L1, CDR-L2, CDR-L3, CDR-H1, CDR-H2 and CDR-H3 sequences are those of PALF14.

60. The MBM of any one of embodiments 5 to 10, wherein the CDR-L1, CDR-L2, CDR-L3, CDR-H1, CDR-H2 and CDR-H3 sequences are those of PALF15.

61. The MBM of any one of embodiments 5 to 10, wherein the CDR-L1, CDR-L2, CDR-L3, CDR-H1, CDR-H2 and CDR-H3 sequences are those of PALF16.

62. The MBM of any one of embodiments 5 to 10, wherein the CDR-L1, CDR-L2, CDR-L3, CDR-H1, CDR-H2 and CDR-H3 sequences are those of PALF17.

63. The MBM of any one of embodiments 5 to 10, wherein the CDR-L1, CDR-L2, CDR-L3, CDR-H1, CDR-H2 and CDR-H3 sequences are those of PALF18.

64. The MBM of any one of embodiments 5 to 10, wherein the CDR-L1, CDR-L2, CDR-L3, CDR-H1, CDR-H2 and CDR-H3 sequences are those of PALF19.

65. The MBM of any one of embodiments 5 to 10, wherein the CDR-L1, CDR-L2, CDR-L3, CDR-H1, CDR-H2 and CDR-H3 sequences are those of PALF20.

66. The MBM of any one of embodiments 11 to 18, wherein the CDR-L1, CDR-L2, CDR-L3, CDR-H1, CDR-H2 and CDR-H3 sequences are those of AB3.

67. The MBM of any one of embodiments 11 to 18, wherein the CDR-L1, CDR-L2, CDR-L3, CDR-H1, CDR-H2 and CDR-H3 sequences are those of PI-61.

68. The MBM of any one of embodiments 11 to 18, wherein the CDR-L1, CDR-L2, CDR-L3, CDR-H1, CDR-H2 and CDR-H3 sequences are those of H2/L2-22.

69. The MBM of any one of embodiments 11 to 18, wherein the CDR-L1, CDR-L2, CDR-L3, CDR-H1, CDR-H2 and CDR-H3 sequences are those of H2/L2-88.

70. The MBM of any one of embodiments 11 to 18, wherein the CDR-L1, CDR-L2, CDR-L3, CDR-H1, CDR-H2 and CDR-H3 sequences are those of H2/L2-36.

71. The MBM of any one of embodiments 11 to 18, wherein the CDR-L1, CDR-L2, CDR-L3, CDR-H1, CDR-H2 and CDR-H3 sequences are those of H2/L2-34.

72. The MBM of any one of embodiments 11 to 18, wherein the CDR-L1, CDR-L2, CDR-L3, CDR-H1, CDR-H2 and CDR-H3 sequences are those of H2/L2-68.

73. The MBM of any one of embodiments 11 to 18, wherein the CDR-L1, CDR-L2, CDR-L3, CDR-H1, CDR-H2 and CDR-H3 sequences are those of H2/L2-18.

74. The MBM of any one of embodiments 11 to 18, wherein the CDR-L1, CDR-L2, CDR-L3, CDR-H1, CDR-H2 and CDR-H3 sequences are those of H2/L2-47.

75. The MBM of any one of embodiments 11 to 18, wherein the CDR-L1, CDR-L2, CDR-L3, CDR-H1, CDR-H2 and CDR-H3 sequences are those of H2/L2-20.

76. The MBM of any one of embodiments 11 to 18, wherein the CDR-L1, CDR-L2, CDR-L3, CDR-H1, CDR-H2 and CDR-H3 sequences are those of H2/L2-80.

77. The MBM of any one of embodiments 11 to 18, wherein the CDR-L1, CDR-L2, CDR-L3, CDR-H1, CDR-H2 and CDR-H3 sequences are those of H2/L2-83.

78. The MBM of any one of embodiments 11 to 18, wherein the CDR-L1, CDR-L2, CDR-L3, CDR-H1, CDR-H2 and CDR-H3 sequences are those of H3-1.

79. The MBM of any one of embodiments 11 to 18, wherein the CDR-L1, CDR-L2, CDR-L3, CDR-H1, CDR-H2 and CDR-H3 sequences are those of H3-2.

80. The MBM of any one of embodiments 11 to 18, wherein the CDR-L1, CDR-L2, CDR-L3, CDR-H1, CDR-H2 and CDR-H3 sequences are those of H3-3.

81. The MBM of any one of embodiments 11 to 18, wherein the CDR-L1, CDR-L2, CDR-L3, CDR-H1, CDR-H2 and CDR-H3 sequences are those of H3-4.

82. The MBM of any one of embodiments 11 to 18, wherein the CDR-L1, CDR-L2, CDR-L3, CDR-H1, CDR-H2 and CDR-H3 sequences are those of H3-5.

83. The MBM of any one of embodiments 11 to 18, wherein the CDR-L1, CDR-L2, CDR-L3, CDR-H1, CDR-H2 and CDR-H3 sequences are those of H3-6.

84. The MBM of any one of embodiments 11 to 18, wherein the CDR-L1, CDR-L2, CDR-L3, CDR-H1, CDR-H2 and CDR-H3 sequences are those of H3-7.

85. The MBM of any one of embodiments 11 to 18, wherein the CDR-L1, CDR-L2, CDR-L3, CDR-H1, CDR-H2 and CDR-H3 sequences are those of H3-8.

86. The MBM of any one of embodiments 11 to 18, wherein the CDR-L1, CDR-L2, CDR-L3, CDR-H1, CDR-H2 and CDR-H3 sequences are those of H3-9.

87. The MBM of any one of embodiments 11 to 18, wherein the CDR-L1, CDR-L2, CDR-L3, CDR-H1, CDR-H2 and CDR-H3 sequences are those of H3-10.

88. The MBM of any one of embodiments 11 to 18, wherein the CDR-L1, CDR-L2, CDR-L3, CDR-H1, CDR-H2 and CDR-H3 sequences are those of H3-11.

89. The MBM of any one of embodiments 11 to 18, wherein the CDR-L1, CDR-L2, CDR-L3, CDR-H1, CDR-H2 and CDR-H3 sequences are those of H3-12.

90. The MBM of any one of embodiments 11 to 18, wherein the CDR-L1, CDR-L2, CDR-L3, CDR-H1, CDR-H2 and CDR-H3 sequences are those of H3-13.

91. The MBM of any one of embodiments 11 to 18, wherein the CDR-L1, CDR-L2, CDR-L3, CDR-H1, CDR-H2 and CDR-H3 sequences are those of H3-14.

92. The MBM of any one of embodiments 11 to 18, wherein the CDR-L1, CDR-L2, CDR-L3, CDR-H1, CDR-H2 and CDR-H3 sequences are those of H3-15.

93. The MBM of embodiment 1 or embodiment 2, wherein ABM1 comprises a light chain variable sequence set forth in Table 11O-1 and the corresponding heavy chain variable sequence set forth in Table 11O-2.

94. The MBM of embodiment 93, wherein the light chain variable sequence and the corresponding heavy chain variable sequence are those of AB1.

95. The MBM of embodiment 93, wherein the light chain variable sequence and the corresponding heavy chain variable sequence are those of AB2.

96. The MBM of embodiment 93, wherein the light chain variable sequence and the corresponding heavy chain variable sequence are those of AB3.

97. The MBM of embodiment 93, wherein the light chain variable sequence and the corresponding heavy chain variable sequence are those of R1F2.

98. The MBM of embodiment 93, wherein the light chain variable sequence and the corresponding heavy chain variable sequence are those of PALF03.

99. The MBM of embodiment 93, wherein the light chain variable sequence and the corresponding heavy chain variable sequence are those of PALF04.

100. The MBM of embodiment 93, wherein the light chain variable sequence and the corresponding heavy chain variable sequence are those of PALF05.

101. The MBM of embodiment 93, wherein the light chain variable sequence and the corresponding heavy chain variable sequence are those of PALF06.

102. The MBM of embodiment 93, wherein the light chain variable sequence and the corresponding heavy chain variable sequence are those of PALF07.

103. The MBM of embodiment 93, wherein the light chain variable sequence and the corresponding heavy chain variable sequence are those of PALF08.

104. The MBM of embodiment 93, wherein the light chain variable sequence and the corresponding heavy chain variable sequence are those of PALF09.

105. The MBM of embodiment 93, wherein the light chain variable sequence and the corresponding heavy chain variable sequence are those of PALF12.

106. The MBM of embodiment 93, wherein the light chain variable sequence and the corresponding heavy chain variable sequence are those of PALF13.

107. The MBM of embodiment 93, wherein the light chain variable sequence and the corresponding heavy chain variable sequence are those of PALF14.

108. The MBM of embodiment 93, wherein the light chain variable sequence and the corresponding heavy chain variable sequence are those of PALF15.

109. The MBM of embodiment 93, wherein the light chain variable sequence and the corresponding heavy chain variable sequence are those of PALF16.

110. The MBM of embodiment 93, wherein the light chain variable sequence and the corresponding heavy chain variable sequence are those of PALF17.

111. The MBM of embodiment 93, wherein the light chain variable sequence and the corresponding heavy chain variable sequence are those of PALF18.

112. The MBM of embodiment 93, wherein the light chain variable sequence and the corresponding heavy chain variable sequence are those of PALF19.

113. The MBM of embodiment 93, wherein the light chain variable sequence and the corresponding heavy chain variable sequence are those of PALF20.

114. The MBM of embodiment 93, wherein the light chain variable sequence and the corresponding heavy chain variable sequence are those of PI-61.

115. The MBM of embodiment 93, wherein the light chain variable sequence and the corresponding heavy chain variable sequence are those of H2/L2-88.

116. The MBM of embodiment 93, wherein the light chain variable sequence and the corresponding heavy chain variable sequence are those of H2/L2-36.

117. The MBM of embodiment 93, wherein the light chain variable sequence and the corresponding heavy chain variable sequence are those of H2/L2-34.

118. The MBM of embodiment 93, wherein the light chain variable sequence and the corresponding heavy chain variable sequence are those of H2/L2-68.

119. The MBM of embodiment 93, wherein the light chain variable sequence and the corresponding heavy chain variable sequence are those of H2/L2-18.

120. The MBM of embodiment 93, wherein the light chain variable sequence and the corresponding heavy chain variable sequence are those of H2/L2-47.

121. The MBM of embodiment 93, wherein the light chain variable sequence and the corresponding heavy chain variable sequence are those of H2/L2-20.

122. The MBM of embodiment 93, wherein the light chain variable sequence and the corresponding heavy chain variable sequence are those of H2/L2-80.

123. The MBM of embodiment 93, wherein the light chain variable sequence and the corresponding heavy chain variable sequence are those of H2/L2-83.

124. The MBM of embodiment 93, wherein the light chain variable sequence and the corresponding heavy chain variable sequence are those of H3-1.

125. The MBM of embodiment 93, wherein the light chain variable sequence and the corresponding heavy chain variable sequence are those of H3-2.

126. The MBM of embodiment 93, wherein the light chain variable sequence and the corresponding heavy chain variable sequence are those of H3-3.

127. The MBM of embodiment 93, wherein the light chain variable sequence and the corresponding heavy chain variable sequence are those of H3-4.

128. The MBM of embodiment 93, wherein the light chain variable sequence and the corresponding heavy chain variable sequence are those of H3-5.

129. The MBM of embodiment 93, wherein the light chain variable sequence and the corresponding heavy chain variable sequence are those of H3-6.

130. The MBM of embodiment 93, wherein the light chain variable sequence and the corresponding heavy chain variable sequence are those of H3-7.

131. The MBM of embodiment 93, wherein the light chain variable sequence and the corresponding heavy chain variable sequence are those of H3-8.

132. The MBM of embodiment 93, wherein the light chain variable sequence and the corresponding heavy chain variable sequence are those of H3-9.

133. The MBM of embodiment 93, wherein the light chain variable sequence and the corresponding heavy chain variable sequence are those of H3-10.

134. The MBM of embodiment 93, wherein the light chain variable sequence and the corresponding heavy chain variable sequence are those of H3-11.

135. The MBM of embodiment 93, wherein the light chain variable sequence and the corresponding heavy chain variable sequence are those of H3-12.

136. The MBM of embodiment 93, wherein the light chain variable sequence and the corresponding heavy chain variable sequence are those of H3-13.

137. The MBM of embodiment 93, wherein the light chain variable sequence and the corresponding heavy chain variable sequence are those of H3-14.

138. The MBM of embodiment 93, wherein the light chain variable sequence and the corresponding heavy chain variable sequence are those of H3-15.

139. The MBM of any one of embodiments 1 to 138, wherein ABM1 is an antibody, an antibody fragment, an scFv, a dsFv, a Fv, a Fab, an scFab, a (Fab')2, or a single domain antibody (SDAB).

140. The MBM of embodiment 139, wherein ABM1 comprises an antibody or an antigen-binding domain thereof.

141. The MBM of embodiment 139, wherein ABM1 comprises a scFv.

142. The MBM of embodiment 141, wherein the scFv of ABM1 comprises a sequence set forth in Table 11P.

143. The MBM of any one of embodiments 1 to 142, wherein ABM2 is a non-immunoglobulin scaffold based ABM.

144. The MBM of embodiment 143, wherein ABM2 is a Kunitz domain, an Adnexin, an Affibody, a DARPin, an Avimer, an Anticalin, a Lipocalin, a Centyrin, a Versabody, a Knottin, an Adnectin, a Pronectin, an Affitin/Nanofitin, an Affilin, an Atrimer/Tetranectin, a bicyclic peptide, a cys-knot, a Fn3 scaffold, an Obody, a Tn3, an Affimer, BD, an Adhiron, a Duocalin, an Alphabody, an Armadillo Repeat Protein, a Repebody, or a Fynomer 145. The MBM of any one of embodiments 1 to 142, wherein ABM2 is an immunoglobulin scaffold based ABM.

146. The MBM of embodiment 145, wherein ABM2 is an antibody, an antibody fragment, an scFv, a dsFv, a Fv, a Fab, an scFab, a (Fab')2, a single domain antibody (SDAB), a VH or VL domain, or a camelid VHH domain.

147. The MBM of embodiment 146, wherein ABM2 is an antibody or an antigen-binding domain thereof.

148. The MBM of embodiment 146, wherein ABM2 is an scFv.

149. The MBM of embodiment 146, wherein ABM2 is a Fab.

150. The MBM of embodiment 149, wherein ABM2 is a Fab heterodimer.

151. The MBM of any one of embodiments 1 to 150, wherein the component of the TCR complex is CD3.

152. The MBM of embodiment 151, wherein ABM2 comprises the CDR sequences of CD3-1.

153. The MBM of embodiment 151, wherein ABM2 comprises the CDR sequences of CD3-2.

154. The MBM of embodiment 151, wherein ABM2 comprises the CDR sequences of CD3-3.

155. The MBM of embodiment 151, wherein ABM2 comprises the CDR sequences of CD3-4.

156. The MBM of embodiment 151, wherein ABM2 comprises the CDR sequences of CD3-5.

157. The MBM of embodiment 151, wherein ABM2 comprises the CDR sequences of CD3-6.

158. The MBM of embodiment 151, wherein ABM2 comprises the CDR sequences of CD3-7.

159. The MBM of embodiment 151, wherein ABM2 comprises the CDR sequences of CD3-8.

160. The MBM of embodiment 151, wherein ABM2 comprises the CDR sequences of CD3-9.

161. The MBM of embodiment 151, wherein ABM2 comprises the CDR sequences of CD3-10.

162. The MBM of embodiment 151, wherein ABM2 comprises the CDR sequences of CD3-11.

163. The MBM of embodiment 151, wherein ABM2 comprises the CDR sequences of CD3-12.

164. The MBM of embodiment 151, wherein ABM2 comprises the CDR sequences of CD3-13.

165. The MBM of embodiment 151, wherein ABM2 comprises the CDR sequences of CD3-14.

166. The MBM of embodiment 151, wherein ABM2 comprises the CDR sequences of CD3-15.

167. The MBM of embodiment 151, wherein ABM2 comprises the CDR sequences of CD3-16.

168. The MBM of embodiment 151, wherein ABM2 comprises the CDR sequences of CD3-17.

169. The MBM of embodiment 151, wherein ABM2 comprises the CDR sequences of CD3-18.

170. The MBM of embodiment 151, wherein ABM2 comprises the CDR sequences of CD3-19.

171. The MBM of embodiment 151, wherein ABM2 comprises the CDR sequences of CD3-20.

172. The MBM of embodiment 151, wherein ABM2 comprises the CDR sequences of CD3-21.

173. The MBM of embodiment 151, wherein ABM2 comprises the CDR sequences of CD3-22.

174. The MBM of embodiment 151, wherein ABM2 comprises the CDR sequences of CD3-23.

175. The MBM of embodiment 151, wherein ABM2 comprises the CDR sequences of CD3-24.

176. The MBM of embodiment 151, wherein ABM2 comprises the CDR sequences of CD3-25.

177. The MBM of embodiment 151, wherein ABM2 comprises the CDR sequences of CD3-26.

178. The MBM of embodiment 151, wherein ABM2 comprises the CDR sequences of CD3-27.

179. The MBM of embodiment 151, wherein ABM2 comprises the CDR sequences of CD3-28.

180. The MBM of embodiment 151, wherein ABM2 comprises the CDR sequences of CD3-29.

181. The MBM of embodiment 151, wherein ABM2 comprises the CDR sequences of CD3-30.

182. The MBM of embodiment 151, wherein ABM2 comprises the CDR sequences of CD3-31.

183. The MBM of embodiment 151, wherein ABM2 comprises the CDR sequences of CD3-32.

184. The MBM of embodiment 151, wherein ABM2 comprises the CDR sequences of CD3-33.

185. The MBM of embodiment 151, wherein ABM2 comprises the CDR sequences of CD3-34.

186. The MBM of embodiment 151, wherein ABM2 comprises the CDR sequences of CD3-35.

187. The MBM of embodiment 151, wherein ABM2 comprises the CDR sequences of CD3-36.

188. The MBM of embodiment 151, wherein ABM2 comprises the CDR sequences of CD3-37.

189. The MBM of embodiment 151, wherein ABM2 comprises the CDR sequences of CD3-38.

190. The MBM of embodiment 151, wherein ABM2 comprises the CDR sequences of CD3-39.

191. The MBM of embodiment 151, wherein ABM2 comprises the CDR sequences of CD3-40.

192. The MBM of embodiment 151, wherein ABM2 comprises the CDR sequences of CD3-41.

193. The MBM of embodiment 151, wherein ABM2 comprises the CDR sequences of CD3-42.

194. The MBM of embodiment 151, wherein ABM2 comprises the CDR sequences of CD3-43.

195. The MBM of embodiment 151, wherein ABM2 comprises the CDR sequences of CD3-44.

196. The MBM of embodiment 151, wherein ABM2 comprises the CDR sequences of CD3-45.

197. The MBM of embodiment 151, wherein ABM2 comprises the CDR sequences of CD3-46.

198. The MBM of embodiment 151, wherein ABM2 comprises the CDR sequences of CD3-47.

199. The MBM of embodiment 151, wherein ABM2 comprises the CDR sequences of CD3-48.

200. The MBM of embodiment 151, wherein ABM2 comprises the CDR sequences of CD3-49.

201. The MBM of embodiment 151, wherein ABM2 comprises the CDR sequences of CD3-50.

202. The MBM of embodiment 151, wherein ABM2 comprises the CDR sequences of CD3-51.

203. The MBM of embodiment 151, wherein ABM2 comprises the CDR sequences of CD3-52.

204. The MBM of embodiment 151, wherein ABM2 comprises the CDR sequences of CD3-53.

205. The MBM of embodiment 151, wherein ABM2 comprises the CDR sequences of CD3-54.

206. The MBM of embodiment 151, wherein ABM2 comprises the CDR sequences of CD3-55.

207. The MBM of embodiment 151, wherein ABM2 comprises the CDR sequences of CD3-56.

208. The MBM of embodiment 151, wherein ABM2 comprises the CDR sequences of CD3-57.

209. The MBM of embodiment 151, wherein ABM2 comprises the CDR sequences of CD3-58.

210. The MBM of embodiment 151, wherein ABM2 comprises the CDR sequences of CD3-59.

211. The MBM of embodiment 151, wherein ABM2 comprises the CDR sequences of CD3-60.

212. The MBM of embodiment 151, wherein ABM2 comprises the CDR sequences of CD3-61.

213. The MBM of embodiment 151, wherein ABM2 comprises the CDR sequences of CD3-62.

214. The MBM of embodiment 151, wherein ABM2 comprises the CDR sequences of CD3-63.

215. The MBM of embodiment 151, wherein ABM2 comprises the CDR sequences of CD3-64.

216. The MBM of embodiment 151, wherein ABM2 comprises the CDR sequences of CD3-65.

217. The MBM of embodiment 151, wherein ABM2 comprises the CDR sequences of CD3-66.

218. The MBM of embodiment 151, wherein ABM2 comprises the CDR sequences of CD3-67.

219. The MBM of embodiment 151, wherein ABM2 comprises the CDR sequences of CD3-68.

220. The MBM of embodiment 151, wherein ABM2 comprises the CDR sequences of CD3-69.

221. The MBM of embodiment 151, wherein ABM2 comprises the CDR sequences of CD3-70.

222. The MBM of embodiment 151, wherein ABM2 comprises the CDR sequences of CD3-71.

223. The MBM of embodiment 151, wherein ABM2 comprises the CDR sequences of CD3-72.

224. The MBM of embodiment 151, wherein ABM2 comprises the CDR sequences of CD3-73.

225. The MBM of embodiment 151, wherein ABM2 comprises the CDR sequences of CD3-74.

226. The MBM of embodiment 151, wherein ABM2 comprises the CDR sequences of CD3-75.

227. The MBM of embodiment 151, wherein ABM2 comprises the CDR sequences of CD3-76.

228. The MBM of embodiment 151, wherein ABM2 comprises the CDR sequences of CD3-77.

229. The MBM of embodiment 151, wherein ABM2 comprises the CDR sequences of CD3-78.

230. The MBM of embodiment 151, wherein ABM2 comprises the CDR sequences of CD3-79.

231. The MBM of embodiment 151, wherein ABM2 comprises the CDR sequences of CD3-80.

232. The MBM of embodiment 151, wherein ABM2 comprises the CDR sequences of CD3-81.

233. The MBM of embodiment 151, wherein ABM2 comprises the CDR sequences of CD3-82.

234. The MBM of embodiment 151, wherein ABM2 comprises the CDR sequences of CD3-83.

235. The MBM of embodiment 151, wherein ABM2 comprises the CDR sequences of CD3-84.

236. The MBM of embodiment 151, wherein ABM2 comprises the CDR sequences of CD3-85.

237. The MBM of embodiment 151, wherein ABM2 comprises the CDR sequences of CD3-86.

238. The MBM of embodiment 151, wherein ABM2 comprises the CDR sequences of CD3-87.

239. The MBM of embodiment 151, wherein ABM2 comprises the CDR sequences of CD3-88.

240. The MBM of embodiment 151, wherein ABM2 comprises the CDR sequences of CD3-89.

241. The MBM of embodiment 151, wherein ABM2 comprises the CDR sequences of CD3-90.

242. The MBM of embodiment 151, wherein ABM2 comprises the CDR sequences of CD3-91.

243. The MBM of embodiment 151, wherein ABM2 comprises the CDR sequences of CD3-92.

244. The MBM of embodiment 151, wherein ABM2 comprises the CDR sequences of CD3-93.

245. The MBM of embodiment 151, wherein ABM2 comprises the CDR sequences of CD3-94.

246. The MBM of embodiment 151, wherein ABM2 comprises the CDR sequences of CD3-95.

247. The MBM of embodiment 151, wherein ABM2 comprises the CDR sequences of CD3-96.

248. The MBM of embodiment 151, wherein ABM2 comprises the CDR sequences of CD3-97.

249. The MBM of embodiment 151, wherein ABM2 comprises the CDR sequences of CD3-98.

250. The MBM of embodiment 151, wherein ABM2 comprises the CDR sequences of CD3-99.

251. The MBM of embodiment 151, wherein ABM2 comprises the CDR sequences of CD3-100.

252. The MBM of embodiment 151, wherein ABM2 comprises the CDR sequences of CD3-101.

253. The MBM of embodiment 151, wherein ABM2 comprises the CDR sequences of CD3-102.

254. The MBM of embodiment 151, wherein ABM2 comprises the CDR sequences of CD3-103.

255. The MBM of embodiment 151, wherein ABM2 comprises the CDR sequences of CD3-104.

256. The MBM of embodiment 151, wherein ABM2 comprises the CDR sequences of CD3-105.

257. The MBM of embodiment 151, wherein ABM2 comprises the CDR sequences of CD3-106.

258. The MBM of embodiment 151, wherein ABM2 comprises the CDR sequences of CD3-107.

259. The MBM of embodiment 151, wherein ABM2 comprises the CDR sequences of CD3-108.

260. The MBM of embodiment 151, wherein ABM2 comprises the CDR sequences of CD3-109.

261. The MBM of embodiment 151, wherein ABM2 comprises the CDR sequences of CD3-110.

262. The MBM of embodiment 151, wherein ABM2 comprises the CDR sequences of CD3-111.

263. The MBM of embodiment 151, wherein ABM2 comprises the CDR sequences of CD3-112.

264. The MBM of embodiment 151, wherein ABM2 comprises the CDR sequences of CD3-113.

265. The MBM of embodiment 151, wherein ABM2 comprises the CDR sequences of CD3-114.

266. The MBM of embodiment 151, wherein ABM2 comprises the CDR sequences of CD3-115.

267. The MBM of embodiment 151, wherein ABM2 comprises the CDR sequences of CD3-116.

268. The MBM of embodiment 151, wherein ABM2 comprises the CDR sequences of CD3-117.

269. The MBM of embodiment 151, wherein ABM2 comprises the CDR sequences of CD3-118.

270. The MBM of embodiment 151, wherein ABM2 comprises the CDR sequences of CD3-119.

271. The MBM of embodiment 151, wherein ABM2 comprises the CDR sequences of CD3-120.

272. The MBM of embodiment 151, wherein ABM2 comprises the CDR sequences of CD3-121.

273. The MBM of embodiment 151, wherein ABM2 comprises the CDR sequences of CD3-122.

274. The MBM of embodiment 151, wherein ABM2 comprises the CDR sequences of CD3-123.

275. The MBM of embodiment 151, wherein ABM2 comprises the CDR sequences of CD3-124.

276. The MBM of embodiment 151, wherein ABM2 comprises the CDR sequences of CD3-125.

277. The MBM of embodiment 151, wherein ABM2 comprises the CDR sequences of CD3-126.

278. The MBM of embodiment 151, wherein ABM2 comprises the CDR sequences of CD3-127.

279. The MBM of embodiment 151, wherein ABM2 comprises the CDR sequences of CD3-128.

280. The MBM of embodiment 151, wherein ABM2 comprises the CDR sequences of CD3-129.

281. The MBM of embodiment 151, wherein ABM2 comprises the CDR sequences of CD3-130.

282. The MBM of any one of embodiments 152 to 281, wherein the CDRs are defined by Kabat numbering, as set forth in Table 12B.

283. The MBM of any one of embodiments 152 to 281, wherein the CDRs are defined by Chothia numbering, as set forth in Table 12C.

284. MBM of any one of embodiments 152 to 281, wherein the CDRs are defined by a combination of Kabat and Chothia numbering, as set forth in Table 12D.

285. The MBM of embodiment 151, wherein ABM2 comprises the heavy and light chain variable sequences of CD3-1, as set forth in Table 12A.

286. The of embodiment 151, wherein ABM2 comprises the heavy and light chain variable sequences of CD3-2, as set forth in Table 12A.

287. The MBM of embodiment 151, wherein ABM2 comprises the heavy and light chain variable sequences of CD3-3, as set forth in Table 12A.

288. The MBM of embodiment 151, wherein ABM2 comprises the heavy and light chain variable sequences of CD3-4, as set forth in Table 12A.

289. The MBM of embodiment 151, wherein ABM2 comprises the heavy and light chain variable sequences of CD3-5, as set forth in Table 12A.

290. The MBM of embodiment 151, wherein ABM2 comprises the heavy and light chain variable sequences of CD3-6, as set forth in Table 12A.

291. The MBM of embodiment 151, wherein ABM2 comprises the heavy and light chain variable sequences of CD3-7, as set forth in Table 12A.

292. The MBM of embodiment 151, wherein ABM2 comprises the heavy and light chain variable sequences of CD3-8, as set forth in Table 12A.

293. The MBM of embodiment 151, wherein ABM2 comprises the heavy and light chain variable sequences of CD3-9, as set forth in Table 12A.

294. The MBM of embodiment 151, wherein ABM2 comprises the heavy and light chain variable sequences of CD3-10, as set forth in Table 12A.

295. The MBM of embodiment 151, wherein ABM2 comprises the heavy and light chain variable sequences of CD3-11, as set forth in Table 12A.

296. The MBM of embodiment 151, wherein ABM2 comprises the heavy and light chain variable sequences of CD3-12, as set forth in Table 12A.

297. The MBM of embodiment 151, wherein ABM2 comprises the heavy and light chain variable sequences of CD3-13, as set forth in Table 12A.

298. The MBM of embodiment 151, wherein ABM2 comprises the heavy and light chain variable sequences of CD3-14, as set forth in Table 12A.

299. The MBM of embodiment 151, wherein ABM2 comprises the heavy and light chain variable sequences of CD3-15, as set forth in Table 12A.

300. The MBM of embodiment 151, wherein ABM2 comprises the heavy and light chain variable sequences of CD3-16, as set forth in Table 12A.

301. The MBM of embodiment 151, wherein ABM2 comprises the heavy and light chain variable sequences of CD3-17, as set forth in Table 12A.

302. The MBM of embodiment 151, wherein ABM2 comprises the heavy and light chain variable sequences of CD3-18, as set forth in Table 12A.

303. The MBM of embodiment 151, wherein ABM2 comprises the heavy and light chain variable sequences of CD3-19, as set forth in Table 12A.

304. The MBM of embodiment 151, wherein ABM2 comprises the heavy and light chain variable sequences of CD3-20, as set forth in Table 12A.

305. The MBM of embodiment 151, wherein ABM2 comprises the heavy and light chain variable sequences of CD3-21, as set forth in Table 12A.

306. The MBM of embodiment 151, wherein ABM2 comprises the heavy and light chain variable sequences of CD3-22, as set forth in Table 12A.

307. The MBM of embodiment 151, wherein ABM2 comprises the heavy and light chain variable sequences of CD3-23, as set forth in Table 12A.

308. The MBM of embodiment 151, wherein ABM2 comprises the heavy and light chain variable sequences of CD3-24, as set forth in Table 12A.

309. The MBM of embodiment 151, wherein ABM2 comprises the heavy and light chain variable sequences of CD3-25, as set forth in Table 12A.

310. The MBM of embodiment 151, wherein ABM2 comprises the heavy and light chain variable sequences of CD3-26, as set forth in Table 12A.

311. The MBM of embodiment 151, wherein ABM2 comprises the heavy and light chain variable sequences of CD3-27, as set forth in Table 12A.

312. The MBM of embodiment 151, wherein ABM2 comprises the heavy and light chain variable sequences of CD3-28, as set forth in Table 12A.

313. The MBM of embodiment 151, wherein ABM2 comprises the heavy and light chain variable sequences of CD3-129, as set forth in Table 12A.

314. The MBM of embodiment 151, wherein ABM2 comprises the heavy and light chain variable sequences of CD3-130, as set forth in Table 12A.

315. The MBM of embodiment 151, wherein ABM2 comprises the amino acid sequence of the scFv designated as CD3-12 in Table 12A.

316. The MBM of embodiment 151, wherein ABM2 comprises the amino acid sequence of the scFv designated as CD3-21 in Table 12A.

317. The MBM of embodiment 151, wherein ABM2 comprises the amino acid sequence of the scFv designated as CD3-22 in Table 12A.

318. The MBM of embodiment 151, wherein ABM2 comprises the amino acid sequence of the scFv designated as CD3-23 in Table 12A.

319. The MBM of embodiment 151, wherein ABM2 comprises the amino acid sequence of the scFv designated as CD3-24 in Table 12A.

320. The MBM of embodiment 151, wherein ABM2 comprises the amino acid sequence of the scFv designated as CD3-25 in Table 12A.

321. The MBM of embodiment 151, wherein ABM2 comprises the amino acid sequence of the scFv designated as CD3-26 in Table 12A.

322. The MBM of embodiment 151, wherein ABM2 comprises the amino acid sequence of the scFv designated as CD3-27 in Table 12A.

323. The MBM of embodiment 151, wherein ABM2 comprises the amino acid sequence of the scFv designated as CD3-28 in Table 12A.

324. The MBM of embodiment 151, wherein ABM2 comprises the amino acid sequence of the scFv designated as CD3-129 in Table 12A.

325. The MBM of embodiment 151, wherein ABM2 comprises the amino acid sequence of the scFv designated as CD3-130 in Table 12A.

326. The MBM of embodiment 151, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AA, Table AB, or Table AC.

327. The MBM of embodiment 326, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AA.

328. The MBM of embodiment 327, wherein the amino acid designated $X_1$ in Table AA is T.

329. The MBM of embodiment 327, wherein the amino acid designated $X_1$ in Table AA is A.

330. The MBM of any one of embodiments 327 to 329, wherein the amino acid designated $X_2$ in Table AA is S.

331. The MBM of any one of embodiments 327 to 329, wherein the amino acid designated $X_2$ in Table AA is R.

332. The MBM of any one of embodiments 327 to 331, wherein the amino acid designated $X_3$ in Table AA is N.

333. The MBM of any one of embodiments 327 to 331, wherein the amino acid designated $X_3$ in Table AA is Y.

334. The MBM of any one of embodiments 327 to 331, wherein the amino acid designated $X_3$ in Table AA is Q.

335. The MBM of any one of embodiments 327 to 334, wherein the amino acid designated $X_4$ in Table AA is H.

336. The MBM of any one of embodiments 327 to 334, wherein the amino acid designated $X_4$ in Table AA is S.

337. The MBM of any one of embodiments 327 to 336, wherein the amino acid designated $X_5$ in Table AA is M.

338. The MBM of any one of embodiments 327 to 336, wherein the amino acid designated $X_5$ in Table AA is L.

339. The MBM of any one of embodiments 327 to 338, wherein the amino acid designated $X_6$ in Table AA is K.

340. The MBM of any one of embodiments 327 to 338, wherein the amino acid designated $X_6$ in Table AA is R.

341. The MBM of any one of embodiments 327 to 340, wherein the amino acid designated $X_7$ in Table AA is S.

342. The MBM of any one of embodiments 327 to 340, wherein the amino acid designated $X_7$ in Table AA is K.

343. The MBM of any one of embodiments 327 to 342, wherein the amino acid designated $X_{55}$ in Table AA is F.

344. The MBM of any one of embodiments 327 to 342, wherein the amino acid designated $X_{55}$ in Table AA is Y.

345. The MBM of any one of embodiments 327 to 342, wherein the amino acid designated $X_{55}$ in Table AA is S.

346. The MBM of any one of embodiments 327 to 345, wherein the amino acid designated $X_8$ in Table AA is W.

347. The MBM of any one of embodiments 327 to 345, wherein the amino acid designated $X_8$ in Table AA is Y.

348. The MBM of any one of embodiments 327 to 345, wherein the amino acid designated $X_8$ in Table AA is S.

349. The MBM of any one of embodiments 327 to 345, wherein the amino acid designated $X_8$ in Table AA is T.

350. The MBM of any one of embodiments 327 to 349, wherein the amino acid designated $X_9$ in Table AA is W.

351. The MBM of any one of embodiments 327 to 349, wherein the amino acid designated $X_9$ in Table AA is Y.

352. The MBM of any one of embodiments 327 to 349, wherein the amino acid designated $X_9$ in Table AA is S.

353. The MBM of any one of embodiments 327 to 349, wherein the amino acid designated $X_9$ in Table AA is T.

354. The MBM of any one of embodiments 327 to 353, wherein the amino acid designated $X_{10}$ in Table AA is H.

355. The MBM of any one of embodiments 327 to 353, wherein the amino acid designated $X_{10}$ in Table AA is Y.

356. The MBM of any one of embodiments 327 to 355, wherein the amino acid designated $X_{11}$ in Table AA is S.

357. The MBM of any one of embodiments 327 to 355, wherein the amino acid designated $X_{11}$ in Table AA is G.

358. The MBM of any one of embodiments 327 to 357, wherein the amino acid designated $X_{12}$ in Table AA is I.

359. The MBM of any one of embodiments 327 to 357, wherein the amino acid designated $X_{12}$ in Table AA is L.

360. The MBM of any one of embodiments 327 to 359, wherein the amino acid designated $X_{13}$ in Table AA is V.

361. The MBM of any one of embodiments 327 to 359, wherein the amino acid designated $X_{13}$ in Table AA is G.

362. The MBM of any one of embodiments 327 to 361, wherein the amino acid designated $X_{14}$ in Table AA is R.

363. The MBM of any one of embodiments 327 to 361, wherein the amino acid designated $X_{14}$ in Table AA is N.

364. The MBM of any one of embodiments 327 to 363, wherein the amino acid designated $X_{15}$ in Table AA is D.

365. The MBM of any one of embodiments 327 to 363, wherein the amino acid designated $X_{15}$ in Table AA is E.

366. The MBM of any one of embodiments 327 to 363, wherein the amino acid designated $X_{15}$ in Table AA is L.

367. The MBM of any one of embodiments 327 to 366, wherein the amino acid designated $X_{16}$ in Table AA is G.

368. The MBM of any one of embodiments 327 to 366, wherein the amino acid designated $X_{16}$ in Table AA is N.

369. The MBM of any one of embodiments 327 to 366, wherein the amino acid designated $X_{16}$ in Table AA is E.

370. The MBM of any one of embodiments 327 to 369, wherein the amino acid designated $X_{17}$ in Table AA is R.

371. The MBM of any one of embodiments 327 to 369, wherein the amino acid designated $X_{17}$ in Table AA is S.

372. The MBM of any one of embodiments 327 to 371, wherein the amino acid designated $X_{18}$ in Table AA is V.

373. The MBM of any one of embodiments 327 to 371, wherein the amino acid designated $X_{18}$ in Table AA is T.

374. The MBM of any one of embodiments 327 to 373, wherein the amino acid designated $X_{19}$ in Table AA is N.

375. The MBM of any one of embodiments 327 to 373, wherein the amino acid designated $X_{19}$ in Table AA is T.

376. The MBM of any one of embodiments 327 to 375, wherein the amino acid designated $X_{20}$ in Table AA is R.

377. The MBM of any one of embodiments 327 to 375, wherein the amino acid designated $X_{20}$ in Table AA is L.

378. The MBM of any one of embodiments 327 to 377, wherein the amino acid designated $X_{21}$ in Table AA is F.

379. The MBM of any one of embodiments 327 to 377, wherein the amino acid designated $X_{21}$ in Table AA is E.

380. The MBM of any one of embodiments 327 to 379, wherein the amino acid designated $X_{22}$ in Table AA is S.

381. The MBM of any one of embodiments 327 to 379, wherein the amino acid designated $X_{22}$ in Table AA is Y.

382. The MBM of any one of embodiments 327 to 381, wherein the amino acid designated $X_{23}$ in Table AA is S.

383. The MBM of any one of embodiments 327 to 381, wherein the amino acid designated $X_{23}$ in Table AA is Y.

384. The MBM of any one of embodiments 327 to 383, wherein the amino acid designated $X_{24}$ in Table AA is S.

385. The MBM of any one of embodiments 327 to 383, wherein the amino acid designated $X_{24}$ in Table AA is A.

386. The MBM of any one of embodiments 327 to 385, wherein the amino acid designated $X_{25}$ in Table AA is H.

387. The MBM of any one of embodiments 327 to 385, wherein the amino acid designated $X_{25}$ in Table AA is T.

388. The MBM of any one of embodiments 327 to 387, wherein the amino acid designated $X_{26}$ in Table AA is F.

389. The MBM of any one of embodiments 327 to 387, wherein the amino acid designated $X_{26}$ in Table AA is Y.

390. The MBM of any one of embodiments 327 to 389, wherein the amino acid designated $X_{27}$ in Table AA is W.

391. The MBM of any one of embodiments 327 to 389, wherein the amino acid designated $X_{27}$ in Table AA is Y.

392. The MBM of any one of embodiments 327 to 391, wherein ABM2 comprises the CDR-H1 sequence C1-1.

393. The MBM of any one of embodiments 327 to 391, wherein ABM2 comprises the CDR-H1 sequence C1-2.

394. The MBM of any one of embodiments 327 to 391, wherein ABM2 comprises the CDR-H1 sequence C1-3.

395. The MBM of any one of embodiments 327 to 391, wherein ABM2 comprises the CDR-H1 sequence C1-4.

396. The MBM of any one of embodiments 327 to 395, wherein ABM2 comprises the CDR-H2 sequence C1-5.

397. The MBM of any one of embodiments 327 to 395, wherein ABM2 comprises the CDR-H2 sequence C1-6.

398. The MBM of any one of embodiments 327 to 395, wherein ABM2 comprises the CDR-H2 sequence C1-7.

399. The MBM of any one of embodiments 327 to 398, wherein ABM2 comprises the CDR-H3 sequence C1-8.

400. The MBM of any one of embodiments 327 to 398, wherein ABM2 comprises the CDR-H3 sequence C1-9.

401. The MBM of any one of embodiments 327 to 398, wherein ABM2 comprises the CDR-H3 sequence C1-10.

402. The MBM of any one of embodiments 327 to 398, wherein ABM2 comprises the CDR-H3 sequence C1-11.

403. The MBM of any one of embodiments 327 to 402, wherein ABM2 comprises the CDR-L1 sequence C1-12.

404. The MBM of any one of embodiments 327 to 402, wherein ABM2 comprises the CDR-L1 sequence C1-13.

405. The MBM of any one of embodiments 327 to 402, wherein ABM2 comprises the CDR-L1 sequence C1-14.

406. The MBM of any one of embodiments 327 to 402, wherein ABM2 comprises the CDR-L1 sequence C1-15.

407. The MBM of any one of embodiments 327 to 402, wherein ABM2 comprises the CDR-L1 sequence C1-16.

408. The MBM of any one of embodiments 327 to 402, wherein ABM2 comprises the CDR-L1 sequence C1-17.

409. The MBM of any one of embodiments 327 to 408, wherein ABM2 comprises the CDR-L2 sequence C1-18.

410. The MBM of any one of embodiments 327 to 408, wherein ABM2 comprises the CDR-L2 sequence C1-19.

411. The MBM of any one of embodiments 327 to 410, wherein ABM2 comprises the CDR-L3 sequence C1-20.

412. The MBM of any one of embodiments 327 to 410, wherein ABM2 comprises the CDR-L3 sequence C1-21.

413. The MBM of any one of embodiments 327 to 410, wherein ABM2 comprises the CDR-L3 sequence C1-22.

414. The MBM of any one of embodiments 327 to 410, wherein ABM2 comprises the CDR-L3 sequence C1-23.

415. The MBM of embodiment 326, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AB.

416. The MBM of embodiment 415, wherein the amino acid designated $X_{28}$ in Table AB is V.

417. The MBM of embodiment 415, wherein the amino acid designated $X_{28}$ in Table AB is I.

418. The MBM of any one of embodiments 415 to 417, wherein the amino acid designated $X_{29}$ in Table AB is F.

419. The MBM of any one of embodiments 415 to 417, wherein the amino acid designated $X_{29}$ in Table AB is Y.

420. The MBM of any one of embodiments 415 to 419, wherein the amino acid designated $X_{30}$ in Table AB is N.

421. The MBM of any one of embodiments 415 to 419, wherein the amino acid designated $X_{30}$ in Table AB is S.

422. The MBM of any one of embodiments 415 to 421, wherein the amino acid designated $X_{31}$ in Table AB is A.

423. The MBM of any one of embodiments 415 to 421, wherein the amino acid designated $X_{31}$ in Table AB is S.

424. The MBM of any one of embodiments 415 to 423, wherein the amino acid designated $X_{32}$ in Table AB is T.

425. The MBM of any one of embodiments 415 to 423, wherein the amino acid designated $X_{32}$ in Table AB is K.

426. The MBM of any one of embodiments 415 to 425, wherein the amino acid designated $X_{33}$ in Table AB is T.

427. The MBM of any one of embodiments 415 to 425, wherein the amino acid designated $X_{33}$ in Table AB is A.

428. The MBM of any one of embodiments 415 to 427, wherein the amino acid designated $X_{34}$ in Table AB is S.

429. The MBM of any one of embodiments 415 to 427, wherein the amino acid designated $X_{34}$ in Table AB is R.

430. The MBM of any one of embodiments 415 to 429, wherein the amino acid designated $X_{35}$ in Table AB is N.

431. The MBM of any one of embodiments 415 to 429, wherein the amino acid designated $X_{35}$ in Table AB is G.

432. The MBM of any one of embodiments 415 to 431, wherein the amino acid designated $X_{36}$ in Table AB is S.

433. The MBM of any one of embodiments 415 to 431, wherein the amino acid designated $X_{36}$ in Table AB is A.

434. The MBM of any one of embodiments 415 to 433, wherein the amino acid designated $X_{37}$ in Table AB is A.

435. The MBM of any one of embodiments 415 to 433, wherein the amino acid designated $X_{37}$ in Table AB is T.

436. The MBM of any one of embodiments 415 to 433, wherein the amino acid designated $X_{37}$ in Table AB is S.

437. The MBM of any one of embodiments 415 to 436, wherein the amino acid designated $X_{38}$ in Table AB is N.

438. The MBM of any one of embodiments 415 to 436, wherein the amino acid designated $X_{38}$ in Table AB is D.

439. The MBM of any one of embodiments 415 to 438, wherein the amino acid designated $X_{39}$ in Table AB is N.

440. The MBM of any one of embodiments 415 to 438, wherein the amino acid designated $X_{39}$ in Table AB is K.

441. The MBM of any one of embodiments 415 to 440, wherein the amino acid designated $X_{40}$ in Table AB is D.

442. The MBM of any one of embodiments 415 to 440, wherein the amino acid designated $X_{40}$ in Table AB is N.

443. The MBM of any one of embodiments 415 to 442, wherein the amino acid designated $X_{41}$ in Table AB is H.

444. The MBM of any one of embodiments 415 to 442, wherein the amino acid designated $X_{41}$ in Table AB is N.

445. The MBM of any one of embodiments 415 to 444, wherein the amino acid designated $X_{42}$ in Table AB is Q.

446. The MBM of any one of embodiments 415 to 444, wherein the amino acid designated $X_{42}$ in Table AB is E.

447. The MBM of any one of embodiments 415 to 446, wherein the amino acid designated $X_{43}$ in Table AB is R.

448. The MBM of any one of embodiments 415 to 446, wherein the amino acid designated $X_{43}$ in Table AB is S.

449. The MBM of any one of embodiments 415 to 446, wherein the amino acid designated $X_{43}$ in Table AB is G.

450. The MBM of any one of embodiments 415 to 449, wherein ABM2 comprises the CDR-H1 sequence C2-1.

451. The MBM of any one of embodiments 415 to 449, wherein ABM2 comprises the CDR-H1 sequence C2-2.

452. The MBM of any one of embodiments 415 to 449, wherein ABM2 comprises the CDR-H1 sequence C2-3.

453. The MBM of any one of embodiments 415 to 449, wherein ABM2 comprises the CDR-H1 sequence C2-4.

454. The MBM of any one of embodiments 415 to 453, wherein ABM2 comprises the CDR-H2 sequence C2-5.

455. The MBM of any one of embodiments 415 to 453, wherein ABM2 comprises the CDR-H2 sequence C2-6.

456. The MBM of any one of embodiments 415 to 453, wherein ABM2 comprises the CDR-H2 sequence C2-7.

457. The MBM of any one of embodiments 415 to 456, wherein ABM2 comprises the CDR-H3 sequence C2-8.

458. The MBM of any one of embodiments 415 to 456, wherein ABM2 comprises the CDR-H3 sequence C2-9.

459. The MBM of any one of embodiments 415 to 458, wherein ABM2 comprises the CDR-L1 sequence C2-10.

460. The MBM of any one of embodiments 415 to 458, wherein ABM2 comprises the CDR-L1 sequence C2-11.

461. The MBM of any one of embodiments 415 to 458, wherein ABM2 comprises the CDR-L1 sequence C2-12.

462. The MBM of any one of embodiments 415 to 461, wherein ABM2 comprises the CDR-L2 sequence C2-13.

463. The MBM of any one of embodiments 415 to 461, wherein ABM2 comprises the CDR-L2 sequence C2-14.

464. The MBM of any one of embodiments 415 to 461, wherein ABM2 comprises the CDR-L2 sequence C2-15.

465. The MBM of any one of embodiments 415 to 464, wherein ABM2 comprises the CDR-L3 sequence C2-16.

466. The MBM of any one of embodiments 415 to 464, wherein ABM2 comprises the CDR-L3 sequence C2-17.

467. The MBM of embodiment 326, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AC.

468. The MBM of embodiment 467, wherein the amino acid designated $X_{44}$ in Table AC is G.

469. The MBM of embodiment 467, wherein the amino acid designated $X_{44}$ in Table AC is A.

470. The MBM of any one of embodiments 467 to 469, wherein the amino acid designated $X_{45}$ in Table AC is H.

471. The MBM of any one of embodiments 467 to 469, wherein the amino acid designated $X_{45}$ in Table AC is N.

472. The MBM of any one of embodiments 467 to 471, wherein the amino acid designated $X_{46}$ in Table AC is D.

473. The MBM of any one of embodiments 467 to 471, wherein the amino acid designated $X_{46}$ in Table AC is G.

474. The MBM of any one of embodiments 467 to 473, wherein the amino acid designated $X_{47}$ in Table AC is A.

475. The MBM of any one of embodiments 467 to 473, wherein the amino acid designated $X_{47}$ in Table AC is G.

476. The MBM of any one of embodiments 467 to 475, wherein the amino acid designated $X_{48}$ in Table AC is N.

477. The MBM of any one of embodiments 467 to 475, wherein the amino acid designated $X_{48}$ in Table AC is K.

478. The MBM of any one of embodiments 467 to 477, wherein the amino acid designated $X_{49}$ in Table AC is V.

479. The MBM of any one of embodiments 467 to 477, wherein the amino acid designated $X_{49}$ in Table AC is A.

480. The MBM of any one of embodiments 467 to 479, wherein the amino acid designated $X_{50}$ in Table AC is N.

481. The MBM of any one of embodiments 467 to 479, wherein the amino acid designated $X_{50}$ in Table AC is V.

482. The MBM of any one of embodiments 467 to 481, wherein the amino acid designated $X_{51}$ in Table AC is A.

483. The MBM of any one of embodiments 467 to 481, wherein the amino acid designated $X_{51}$ in Table AC is V.

484. The MBM of any one of embodiments 467 to 483, wherein the amino acid designated $X_{52}$ in Table AC is Y.

485. The MBM of any one of embodiments 467 to 483, wherein the amino acid designated $X_{52}$ in Table AC is F.

486. The MBM of any one of embodiments 467 to 485, wherein the amino acid designated $X_{53}$ in Table AC is I.

487. The MBM of any one of embodiments 467 to 485, wherein the amino acid designated $X_{53}$ in Table AC is V.

488. The MBM of any one of embodiments 467 to 487, wherein the amino acid designated $X_{54}$ in Table AC is I.

489. The MBM of any one of embodiments 467 to 487, wherein the amino acid designated $X_{54}$ in Table AC is H.

490. The MBM of any one of embodiments 467 to 489, wherein ABM2 comprises the CDR-H1 sequence C3-1.

491. The MBM of any one of embodiments 467 to 489, wherein ABM2 comprises the CDR-H1 sequence C3-2.

492. The MBM of any one of embodiments 467 to 489, wherein ABM2 comprises the CDR-H1 sequence C3-3.

493. The MBM of any one of embodiments 467 to 489, wherein ABM2 comprises the CDR-H1 sequence C3-4.

494. The MBM of any one of embodiments 467 to 493, wherein ABM2 comprises the CDR-H2 sequence C3-5.

495. The MBM of any one of embodiments 467 to 493, wherein ABM2 comprises the CDR-H2 sequence C3-6.

496. The MBM of any one of embodiments 467 to 493, wherein ABM2 comprises the CDR-H2 sequence C3-7.

497. The MBM of any one of embodiments 467 to 496, wherein ABM2 comprises the CDR-H3 sequence C3-8.

498. The MBM of any one of embodiments 467 to 496, wherein ABM2 comprises the CDR-H3 sequence C3-9.

499. The MBM of any one of embodiments 467 to 498, wherein ABM2 comprises the CDR-L1 sequence C3-10.

500. The MBM of any one of embodiments 467 to 498, wherein ABM2 comprises the CDR-L1 sequence C3-11.

501. The MBM of any one of embodiments 467 to 498, wherein ABM2 comprises the CDR-L1 sequence C3-12.

502. The MBM of any one of embodiments 467 to 501, wherein ABM2 comprises the CDR-L2 sequence C3-13.

503. The MBM of any one of embodiments 467 to 501, wherein ABM2 comprises the CDR-L2 sequence C3-14.

504. The MBM of any one of embodiments 467 to 503, wherein ABM2 comprises the CDR-L3 sequence C3-15.

505. The MBM of any one of embodiments 467 to 503, wherein ABM2 comprises the CDR-L3 sequence C3-16.

506. The MBM of embodiment 151, wherein ABM2 comprises CDR-H1 CDR-H2, and CDR-H3 sequences set forth in Table AD-1, Table AE-1, Table AF-1, Table AG-1, Table AH-1, or Table AI-1, and the corresponding CDR-L1, CDR-L2, and CDR-L3 sequences set forth in Table AD-2, Table AE-2, Table AF-2, Table AG-2, Table AH-2, or Table AI-2, respectfully.

507. The MBM of embodiment 506, wherein ABM2 comprises CDR-H1, CDR-H2, and CDR-H3 sequences set forth in Table AD-1 and the corresponding CDR-L1, CDR-L2, and CDR-L3 sequences set forth in Table AD-2.

508. The MBM of embodiment 506, wherein ABM2 comprises CDR-H1, CDR-H2, and CDR-H3 sequences set forth in Table AE-1 and the corresponding CDR-L1, CDR-L2, and CDR-L3 sequences set forth in Table AE-2.

509. The MBM of embodiment 506, wherein ABM2 comprises CDR-H1, CDR-H2, and CDR-H3 sequences set forth in Table AF-1 and the corresponding CDR-L1, CDR-L2, and CDR-L3 sequences set forth in Table AF-2.

510. The MBM of embodiment 506, wherein ABM2 comprises CDR-H1, CDR-H2, and CDR-H3 sequences set forth in Table AG-1 and the corresponding CDR-L1, CDR-L2, and CDR-L3 sequences set forth in Table AG-2.

511. The MBM of embodiment 506, wherein ABM2 comprises CDR-H1, CDR-H2, and CDR-H3 sequences set forth in Table AH-1 and the corresponding CDR-L1, CDR-L2, and CDR-L3 sequences set forth in Table AH-2.

512. The MBM of embodiment 506, wherein ABM2 comprises CDR-H1, CDR-H2, and CDR-H3 sequences set forth in Table AI-1 and the corresponding CDR-L1, CDR-L2, and CDR-L3 sequences set forth in Table AI-2.

513. The MBM of any one of embodiments 507 to 512, wherein ABM2 comprises CDR-H1, CDR-H2, CDR-H3, CDR-L1, CDR-L2, and CDR-L3 sequences of NOV292.

514. The MBM of any one of embodiments 507 to 512, wherein ABM2 comprises CDR-H1, CDR-H2, CDR-H3, CDR-L1, CDR-L2, and CDR-L3 sequences of NOV123.

515. The MBM of any one of embodiments 507 to 512, wherein ABM2 comprises CDR-H1, CDR-H2, CDR-H3, CDR-L1, CDR-L2, and CDR-L3 sequences of Sp10b.

516. The MBM of any one of embodiments 507 to 512, wherein ABM2 comprises CDR-H1, CDR-H2, CDR-H3, CDR-L1, CDR-L2, and CDR-L3 sequences of NOV453.

517. The MBM of any one of embodiments 507 to 512, wherein ABM2 comprises CDR-H1, CDR-H2, CDR-H3, CDR-L1, CDR-L2, and CDR-L3 sequences of NOV229.

518. The MBM of any one of embodiments 507 to 512, wherein ABM2 comprises CDR-H1, CDR-H2, CDR-H3, CDR-L1, CDR-L2, and CDR-L3 sequences of NOV110.

519. The MBM of any one of embodiments 507 to 512, wherein ABM2 comprises CDR-H1, CDR-H2, CDR-H3, CDR-L1, CDR-L2, and CDR-L3 sequences of NOV832.

520. The MBM of any one of embodiments 507 to 512, wherein ABM2 comprises CDR-H1, CDR-H2, CDR-H3, CDR-L1, CDR-L2, and CDR-L3 sequences of NOV589.

521. The MBM of any one of embodiments 507 to 512, wherein ABM2 comprises CDR-H1, CDR-H2, CDR-H3, CDR-L1, CDR-L2, and CDR-L3 sequences of NOV580.

522. The MBM of any one of embodiments 507 to 512, wherein ABM2 comprises CDR-H1, CDR-H2, CDR-H3, CDR-L1, CDR-L2, and CDR-L3 sequences of NOV567.

523. The MBM of any one of embodiments 507 to 512, wherein ABM2 comprises CDR-H1, CDR-H2, CDR-H3, CDR-L1, CDR-L2, and CDR-L3 sequences of NOV221.

524. The MBM of any one of embodiments 507 to 512, wherein ABM2 comprises CDR-H1, CDR-H2, CDR-H3, CDR-L1, CDR-L2, and CDR-L3 sequences of CD3_sp11a_bkm1.

525. The MBM of any one of embodiments 507 to 512, wherein ABM2 comprises CDR-H1, CDR-H2, CDR-H3, CDR-L1, CDR-L2, and CDR-L3 sequences of CD3_SP11a_bkm2.

526. The MBM of any one of embodiments 507 to 512, wherein ABM2 comprises CDR-H1, CDR-H2, CDR-H3, CDR-L1, CDR-L2, and CDR-L3 sequences of CD3_sp11a_hz0.

527. The MBM of any one of embodiments 507 to 512, wherein ABM2 comprises CDR-H1, CDR-H2, CDR-H3, CDR-L1, CDR-L2, and CDR-L3 sequences of CD3_SP11A_HZ1.

528. The MBM of any one of embodiments 507 to 512, wherein ABM2 comprises CDR-H1, CDR-H2, CDR-H3, CDR-L1, CDR-L2, and CDR-L3 sequences of CD3_sp11a_sansPTM_hz1.

529. The MBM of any one of embodiments 507 to 512, wherein ABM2 comprises CDR-H1, CDR-H2, CDR-H3, CDR-L1, CDR-L2, and CDR-L3 sequences of CD3_sp11a_sansPTM_rat.

530. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY.

531. The MBM of any one of embodiments 507 to 512, wherein ABM2 comprises CDR-H1, CDR-H2, CDR-H3, CDR-L1, CDR-L2, and CDR-L3 sequences of CD3_P11A_VHVL_SS.

532. The MBM of any one of embodiments 507 to 512, wherein ABM2 comprises CDR-H1, CDR-H2, CDR-H3, CDR-L1, CDR-L2, and CDR-L3 sequences of CD3_SP11A_VHVL_WS.

533. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW.

534. The MBM of any one of embodiments 507 to 512, wherein ABM2 comprises CDR-H1, CDR-H2, CDR-H3, CDR-L1, CDR-L2, and CDR-L3 sequences of CD3_SP11A_VHVL_TT.

535. The MBM of any one of embodiments 507 to 512, wherein ABM2 comprises CDR-H1, CDR-H2, CDR-H3, CDR-L1, CDR-L2, and CDR-L3 sequences of CD3_SP11A_VHVL_TW.

536. The MBM of any one of embodiments 507 to 512, wherein ABM2 comprises CDR-H1, CDR-H2, CDR-H3, CDR-L1, CDR-L2, and CDR-L3 sequences of CD3_SP11A_VHVL_TW.

537. The MBM of any one of embodiments 507 to 512, wherein ABM2 comprises CDR-H1, CDR-H2, CDR-H3, CDR-L1, CDR-L2, and CDR-L3 sequences of CD3_SP11A VH3_VLK_3.

538. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2.

539. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1.

540. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2.

541. The MBM of any one of embodiments 507 to 512, wherein ABM2 comprises CDR-H1, CDR-H2, CDR-H3, CDR-L1, CDR-L2, and CDR-L3 sequences of CD3_sp9aFW1_VL_VH_S56G.

542. The MBM of any one of embodiments 507 to 512, wherein ABM2 comprises CDR-H1, CDR-H2, CDR-H3, CDR-L1, CDR-L2, and CDR-L3 sequences of CD3_SP9AFW4_VL_VH_S56G.

543. The MBM of any one of embodiments 507 to 512, wherein ABM2 comprises CDR-H1, CDR-H2, CDR-H3, CDR-L1, CDR-L2, and CDR-L3 sequences of CD3_sp9aFW1_VL_VH.

544. The MBM of any one of embodiments 507 to 512, wherein ABM2 comprises CDR-H1, CDR-H2, CDR-H3, CDR-L1, CDR-L2, and CDR-L3 sequences of CD3_sp9aFW4_VLVH.

545. The MBM of any one of embodiments 507 to 512, wherein ABM2 comprises CDR-H1, CDR-H2, CDR-H3, CDR-L1, CDR-L2, and CDR-L3 sequences of CD3_sp9arabtor_VHVL.

546. The MBM of any one of embodiments 507 to 512, wherein ABM2 comprises CDR-H1, CDR-H2, CDR-H3, CDR-L1, CDR-L2, and CDR-L3 sequences of CD3_sp9arabtor_VLVH.

547. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY_SANSPTM.

548. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY_SANSPTM_Y.

549. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY_SANSPTM_S.

550. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY_Y.

551. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_YY_s.

552. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_SANSPTM.

553. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_SANSPTM_Y.

554. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_SANSPTM_S.

555. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_Y.

556. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_S.

557. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SS_SANSPTM.

558. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_WS_SANSPTM_Y.

559. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_WS_SANSPTM_S.

560. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_WS_Y.

561. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_WS_S.

562. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_WS_SANSPTM.

563. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW_SANSPTM_Y.

564. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW_SANSPTM_S.

565. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW_Y.

566. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW_S.

567. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_SW_SANSPTM.

568. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TW_SANSPTM_Y.

569. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TW_SANSPTM_S.

570. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TW_.

571. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TW_S.

572. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TW_SANSPTM.

573. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TT_SANSPTM_Y.

574. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TT_SANSPTM_S.

575. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TT_Y.

576. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TT_S.

577. The MBM of any one of embodiments 507 to 512, wherein ABM2 comprises CDR-H1, CDR-H2, CDR-H3, CDR-L1, CDR-L2, and CDR-L3 sequences of CD3_sp11a_VHVL_TT_SANSPTM.

578. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_Y.

579. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_S. 580. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_Y_PTM.

581. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_S_PTM. 582. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_Y_SW.

583. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_S_SW. 584. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_Y_PTM_SW.

585. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_S_SWPTM.

586. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_SWPTM.

587. The MBM of any one of embodiments 507 to 512, wherein ABM2 comprises CDR-H1, CDR-H2, CDR-H3, CDR-L1, CDR-L2, and CDR-L3 sequences of CD3_SP11AVH3_VLK_3_SW.

588. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_Y.

589. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_S.

590. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_Y_PTM.

591. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_S_PTM.

592. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_Y_SW.

593. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_S_SW.

594. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_Y_PTM.

595. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_S_PTM_SW.

596. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_SW.

597. The MBM of any one of embodiments 507 to 512, wherein ABM2 comprises CDR-H1, CDR-H2, CDR-H3, CDR-L1, CDR-L2, and CDR-L3 sequences of CD3_sp11a_VH1_VK2_SW_PTM.

598. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_Y.

599. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_S.

600. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_Y_PTM.

601. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_S_PTM.

602. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_Y_SW.

603. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_S_SW.

604. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3 VLK1 Y_PTM.

605. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3 VLK1 S_PTM_SW.

606. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1PTM_SW.

607. The MBM of any one of embodiments 507 to 512, wherein ABM2 comprises CDR-H1, CDR-H2, CDR-H3, CDR-L1, CDR-L2, and CDR-L3 sequences of CD3_SP11A_VH3_VLK1_SW.

608. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_Y.

609. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_S.

610. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_Y_PTM.

611. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_S_PTM.

612. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_Y_SW.

613. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_S_SW.

614. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_Y_PTM_SW.

615. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_S_PTM_SW.

616. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2 PTM_SW.

617. The MBM of any one of embodiments 507 to 512, wherein ABM2 comprises CDR-H1, CDR-H2, CDR-H3, CDR-L1, CDR-L2, and CDR-L3 sequences of CD3_SP11A_VH5_VK2_SW.

618. The MBM of embodiment 506, wherein ABM2 comprises a heavy chain variable sequence set forth in Table AJ-1 and the corresponding light chain variable sequence set forth in Table AJ-2.

619. The MBM of embodiment 618, wherein ABM2 comprises the heavy chain variable sequence and the light chain variable sequence of NOV292.

620. The MBM of embodiment 618, wherein ABM2 comprises the heavy chain variable sequence and the light chain variable sequence of NOV123.

621. The MBM of embodiment 618, wherein ABM2 comprises the heavy chain variable sequence and the light chain variable sequence of Sp10b.

622. The MBM of embodiment 618, wherein ABM2 comprises the heavy chain variable sequence and the light chain variable sequence of NOV453.

623. The MBM of embodiment 618, wherein ABM2 comprises the heavy chain variable sequence and the light chain variable sequence of NOV229.

624. The MBM of embodiment 618, wherein ABM2 comprises the heavy chain variable sequence and the light chain variable sequence of NOV110.

625. The MBM of embodiment 618, wherein ABM2 comprises the heavy chain variable sequence and the light chain variable sequence of NOV832.

626. The MBM of embodiment 618, wherein ABM2 comprises the heavy chain variable sequence and the light chain variable sequence of NOV589.

627. The MBM of embodiment 618, wherein ABM2 comprises the heavy chain variable sequence and the light chain variable sequence of NOV580.

628. The MBM of embodiment 618, wherein ABM2 comprises the heavy chain variable sequence and the light chain variable sequence of NOV567.

629. The MBM of embodiment 618, wherein ABM2 comprises the heavy chain variable sequence and the light chain variable sequence of NOV221.

630. The MBM of embodiment 618, wherein ABM2 comprises the heavy chain variable sequence and the light chain variable sequence of CD3_sp11a_bkm1.

631. The MBM of embodiment 618, wherein ABM2 comprises the heavy chain variable sequence and the light chain variable sequence of CD3_SP11a_bkm2.

632. The MBM of embodiment 618, wherein ABM2 comprises the heavy chain variable sequence and the light chain variable sequence of CD3_sp11a_hz0.

633. The MBM of embodiment 618, wherein ABM2 comprises the heavy chain variable sequence and the light chain variable sequence of CD3_SP11A_HZ1.

634. The MBM of embodiment 618, wherein ABM2 comprises the heavy chain variable sequence and the light chain variable sequence of CD3_sp11a_sansPTM_hz1.

635. The MBM of embodiment 618, wherein ABM2 comprises the heavy chain variable sequence and the light chain variable sequence of CD3_sp11a_sansPTM_rat.

636. The MBM of embodiment 618, wherein ABM2 comprises the heavy chain variable sequence and the light chain variable sequence of CD3_sp11a_VHVL_YY.

637. The MBM of embodiment 618, wherein ABM2 comprises the heavy chain variable sequence and the light chain variable sequence of CD3_SP11A_VHVL_SS.

638. The MBM of embodiment 618, wherein ABM2 comprises the heavy chain variable sequence and the light chain variable sequence of CD3_SP11A_VHVL_WS.

639. The MBM of embodiment 618, wherein ABM2 comprises the heavy chain variable sequence and the light chain variable sequence of CD3_sp11a_VHVL_SW.

640. The MBM of embodiment 618, wherein ABM2 comprises the heavy chain variable sequence and the light chain variable sequence of CD3_SP11A_VHVL_TT.

641. The MBM of embodiment 618, wherein ABM2 comprises the heavy chain variable sequence and the light chain variable sequence of CD3_SP11A_VHVL_TW.

642. The MBM of embodiment 618, wherein ABM2 comprises the heavy chain variable sequence and the light chain variable sequence of CD3_SP11A_VHVL_VVT.

643. The MBM of embodiment 618, wherein ABM2 comprises the heavy chain variable sequence and the light chain variable sequence of CD3_SP11A VH3_VLK_3.

644. The MBM of embodiment 618, wherein ABM2 comprises the heavy chain variable sequence and the light chain variable sequence of CD3_sp11a_VH1_VK2.

645. The MBM of embodiment 618, wherein ABM2 comprises the heavy chain variable sequence and the light chain variable sequence of CD3_SP11A_VH3_VLK1.

646. The MBM of embodiment 618, wherein ABM2 comprises the heavy chain variable sequence and the light chain variable sequence of CD3_SP11A_VH5_VK2.

647. The MBM of embodiment 618, wherein ABM2 comprises the heavy chain variable sequence and the light chain variable sequence of CD3_sp9aFW1_VL_VH_S56G.

648. The MBM of embodiment 618, wherein ABM2 comprises the heavy chain variable sequence and the light chain variable sequence of CD3_SP9AFW4_VL_VH_S56G.

649. The MBM of embodiment 618, wherein ABM2 comprises the heavy chain variable sequence and the light chain variable sequence of CD3_sp9aFW1_VL_VH.

650. The MBM of embodiment 618, wherein ABM2 comprises the heavy chain variable sequence and the light chain variable sequence of CD3_sp9aFW4_VLVH.

651. The MBM of embodiment 618, wherein ABM2 comprises the heavy chain variable sequence and the light chain variable sequence of CD3_sp9arabtor_VHVL.

652. The MBM of embodiment 618, wherein ABM2 comprises the heavy chain variable sequence and the light chain variable sequence of CD3_sp9arabtor_VLVH.

653. The MBM of embodiment 618, wherein ABM2 comprises the heavy chain variable sequence and the light chain variable sequence of CD3_sp11a_VHVL_YY_SANSPTM.

654. The MBM of embodiment 618, wherein ABM2 comprises the heavy chain variable sequence and the light chain variable sequence of CD3_sp11a_VHVL_YY_SANSPTM_Y.

655. The MBM of embodiment 618, wherein ABM2 comprises the heavy chain variable sequence and the light chain variable sequence of CD3_sp11a_VHVL_YY_SANSPTM_S.

656. The MBM of embodiment 618, wherein ABM2 comprises the heavy chain variable sequence and the light chain variable sequence of CD3_sp11a_VHVL_YY_Y.

657. The MBM of embodiment 618, wherein ABM2 comprises the heavy chain variable sequence and the light chain variable sequence of CD3_sp11a_VHVL_YY_s.

658. The MBM of embodiment 618, wherein ABM2 comprises the heavy chain variable sequence and the light chain variable sequence of CD3_sp11a_VHVL_SS_SANSPTM.

659. The MBM of embodiment 618, wherein ABM2 comprises the heavy chain variable sequence and the light chain variable sequence of CD3_sp11a_VHVL_SS_SANSPTM_Y.

660. The MBM of embodiment 618, wherein ABM2 comprises the heavy chain variable sequence and the light chain variable sequence of CD3_sp11a_VHVL_SS_SANSPTM_S.

661. The MBM of embodiment 618, wherein ABM2 comprises the heavy chain variable sequence and the light chain variable sequence of CD3_sp11a_VHVL_SS_Y.

662. The MBM of embodiment 618, wherein ABM2 comprises the heavy chain variable sequence and the light chain variable sequence of CD3_sp11a_VHVL_SS_S.

663. The MBM of embodiment 618, wherein ABM2 comprises the heavy chain variable sequence and the light chain variable sequence of CD3_sp11a_VHVL_SS_SANSPTM.

664. The MBM of embodiment 618, wherein ABM2 comprises the heavy chain variable sequence and the light chain variable sequence of CD3_sp11a_VHVL_WS_SANSPTM_Y.

665. The MBM of embodiment 618, wherein ABM2 comprises the heavy chain variable sequence and the light chain variable sequence of CD3_sp11a_VHVL_WS_SANSPTM_S.

666. The MBM of embodiment 618, wherein ABM2 comprises the heavy chain variable sequence and the light chain variable sequence of CD3_sp11a_VHVL_WS_.

667. The MBM of embodiment 618, wherein ABM2 comprises the heavy chain variable sequence and the light chain variable sequence of CD3_sp11a_VHVL_WS_S.

668. The MBM of embodiment 618, wherein ABM2 comprises the heavy chain variable sequence and the light chain variable sequence of CD3_sp11a_VHVL_WS_SANSPTM.

669. The MBM of embodiment 618, wherein ABM2 comprises the heavy chain variable sequence and the light chain variable sequence of CD3_sp11a_VHVL_SW_SANSPTM_Y.

670. The MBM of embodiment 618, wherein ABM2 comprises the heavy chain variable sequence and the light chain variable sequence of CD3_sp11a_VHVL_SW_SANSPTM_S.

671. The MBM of embodiment 618, wherein ABM2 comprises the heavy chain variable sequence and the light chain variable sequence of CD3_sp11a_VHVL_SW_Y.

672. The MBM of embodiment 618, wherein ABM2 comprises the heavy chain variable sequence and the light chain variable sequence of CD3_sp11a_VHVL_SW_S.

673. The MBM of embodiment 618, wherein ABM2 comprises the heavy chain variable sequence and the light chain variable sequence of CD3_sp11a_VHVL_SW_SANSPTM.

674. The MBM of embodiment 618, wherein ABM2 comprises the heavy chain variable sequence and the light chain variable sequence of CD3_sp11a_VHVL_TW_SANSPTM_Y.

675. The MBM of embodiment 618, wherein ABM2 comprises the heavy chain variable sequence and the light chain variable sequence of CD3_sp11a_VHVL_TW_SANSPTM_S.

676. The MBM of embodiment 618, wherein ABM2 comprises the heavy chain variable sequence and the light chain variable sequence of CD3_sp11a_VHVL_TW_Y.

677. The MBM of embodiment 618, wherein ABM2 comprises the heavy chain variable sequence and the light chain variable sequence of CD3_sp11a_VHVL_TW_S.

678. The MBM of embodiment 618, wherein ABM2 comprises the heavy chain variable sequence and the light chain variable sequence of CD3_sp11a_VHVL_TW_SANSPTM.

679. The MBM of embodiment 618, wherein ABM2 comprises the heavy chain variable sequence and the light chain variable sequence of CD3_sp11a_VHVL_TT_SANSPTM_Y.

680. The MBM of embodiment 618, wherein ABM2 comprises the heavy chain variable sequence and the light chain variable sequence of CD3_sp11a_VHVL_TT_SANSPTM_S.

681. The MBM of embodiment 618, wherein ABM2 comprises the heavy chain variable sequence and the light chain variable sequence of CD3_sp11a_VHVL_TT_Y.

682. The MBM of embodiment 618, wherein ABM2 comprises the heavy chain variable sequence and the light chain variable sequence of CD3_sp11a_VHVL_TT_S.

683. The MBM of embodiment 618, wherein ABM2 comprises the heavy chain variable sequence and the light chain variable sequence of CD3_sp11a_VHVL_TT_SANSPTM.

684. The MBM of embodiment 618, wherein ABM2 comprises the heavy chain variable sequence and the light chain variable sequence of CD3_SP11AVH3_VLK_3_Y.

685. The MBM of embodiment 618, wherein ABM2 comprises the heavy chain variable sequence and the light chain variable sequence of CD3_SP11AVH3_VLK_3_S.

686. The MBM of embodiment 618, wherein ABM2 comprises the heavy chain variable sequence and the light chain variable sequence of CD3_SP11AVH3_VLK_3_Y_PTM.

687. The MBM of embodiment 618, wherein ABM2 comprises the heavy chain variable sequence and the light chain variable sequence of CD3_SP11AVH3_VLK_3_S_PTM.

688. The MBM of embodiment 618, wherein ABM2 comprises the heavy chain variable sequence and the light chain variable sequence of CD3_SP11AVH3_VLK_3_Y_SW.

689. The MBM of embodiment 618, wherein ABM2 comprises the heavy chain variable sequence and the light chain variable sequence of CD3_SP11AVH3_VLK_3_S_SW.

690. The MBM of embodiment 618, wherein ABM2 comprises the heavy chain variable sequence and the light chain variable sequence of CD3_SP11AVH3_VLK_3_Y_PTM_SW.

691. The MBM of embodiment 618, wherein ABM2 comprises the heavy chain variable sequence and the light chain variable sequence of CD3_SP11AVH3_VLK_3_S_SWPTM.

692. The MBM of embodiment 618, wherein ABM2 comprises the heavy chain variable sequence and the light chain variable sequence of CD3_SP11AVH3_VLK_SWPTM.

693. The MBM of embodiment 618, wherein ABM2 comprises the heavy chain variable sequence and the light chain variable sequence of CD3_SP11AVH3_VLK_3_SW.

694. The MBM of embodiment 618, wherein ABM2 comprises the heavy chain variable sequence and the light chain variable sequence of CD3_sp11a_VH1_VK2_Y.

695. The MBM of embodiment 618, wherein ABM2 comprises the heavy chain variable sequence and the light chain variable sequence of CD3_sp11a_VH1_VK2_S.

696. The MBM of embodiment 618, wherein ABM2 comprises the heavy chain variable sequence and the light chain variable sequence of CD3_sp11a_VH1_VK2_Y_PTM.

697. The MBM of embodiment 618, wherein ABM2 comprises the heavy chain variable sequence and the light chain variable sequence of CD3_sp11a_VH1_VK2_S_PTM.

698. The MBM of embodiment 618, wherein ABM2 comprises the heavy chain variable sequence and the light chain variable sequence of CD3_sp11a_VH1_VK2_Y_SW.

699. The MBM of embodiment 618, wherein ABM2 comprises the heavy chain variable sequence and the light chain variable sequence of CD3_sp11a_VH1_VK2_S_SW.

700. The MBM of embodiment 618, wherein ABM2 comprises the heavy chain variable sequence and the light chain variable sequence of CD3_sp11a_VH1_VK2_Y_PTM.

701. The MBM of embodiment 618, wherein ABM2 comprises the heavy chain variable sequence and the light chain variable sequence of CD3_sp11a_VH1_VK2_S_PTM_SW.

702. The MBM of embodiment 618, wherein ABM2 comprises the heavy chain variable sequence and the light chain variable sequence of CD3_sp11a_VH1_VK2_SW.

703. The MBM of embodiment 618, wherein ABM2 comprises the heavy chain variable sequence and the light chain variable sequence of CD3_sp11a_VH1_VK2_SW_PTM.

704. The MBM of embodiment 618, wherein ABM2 comprises the heavy chain variable sequence and the light chain variable sequence of CD3_SP11A_VH3_VLK1_Y.

705. The MBM of embodiment 618, wherein ABM2 comprises the heavy chain variable sequence and the light chain variable sequence of CD3_SP11A_VH3_VLK1_S.

706. The MBM of embodiment 618, wherein ABM2 comprises the heavy chain variable sequence and the light chain variable sequence of CD3_SP11A_VH3_VLK1_Y_PTM.

707. The MBM of embodiment 618, wherein ABM2 comprises the heavy chain variable sequence and the light chain variable sequence of CD3_SP11A_VH3_VLK1_S_PTM.

708. The MBM of embodiment 618, wherein ABM2 comprises the heavy chain variable sequence and the light chain variable sequence of CD3_SP11A_VH3_VLK1_Y_SW.

709. The MBM of embodiment 618, wherein ABM2 comprises the heavy chain variable sequence and the light chain variable sequence of CD3_SP11A_VH3_VLK1_S_SW.

710. The MBM of embodiment 618, wherein ABM2 comprises the heavy chain variable sequence and the light chain variable sequence of CD3_SP11A_VH3_VLK1_Y_PTM.

711. The MBM of embodiment 618, wherein ABM2 comprises the heavy chain variable sequence and the light chain variable sequence of CD3_SP11A_VH3_VLK1_S_PTM_SW.

712. The MBM of embodiment 618, wherein ABM2 comprises the heavy chain variable sequence and the light chain variable sequence of CD3_SP11A_VH3_VLK1PTM_SW.

713. The MBM of embodiment 618, wherein ABM2 comprises the heavy chain variable sequence and the light chain variable sequence of CD3_SP11A_VH3_VLK1_SW.

714. The MBM of embodiment 618, wherein ABM2 comprises the heavy chain variable sequence and the light chain variable sequence of CD3_SP11A_VH5_VK2_Y.

715. The MBM of embodiment 618, wherein ABM2 comprises the heavy chain variable sequence and the light chain variable sequence of CD3_SP11A_VH5_VK2_S.

716. The MBM of embodiment 618, wherein ABM2 comprises the heavy chain variable sequence and the light chain variable sequence of CD3_SP11A_VH5_VK2_Y_PTM.

717. The MBM of embodiment 618, wherein ABM2 comprises the heavy chain variable sequence and the light chain variable sequence of CD3_SP11A_VH5_VK2_S_PTM.

718. The MBM of embodiment 618, wherein ABM2 comprises the heavy chain variable sequence and the light chain variable sequence of CD3_SP11A_VH5_VK2_Y_SW.

719. The MBM of embodiment 618, wherein ABM2 comprises the heavy chain variable sequence and the light chain variable sequence of CD3_SP11A_VH5_VK2_S_SW.

720. The MBM of embodiment 618, wherein ABM2 comprises the heavy chain variable sequence and the light chain variable sequence of CD3_SP11A_VH5_VK2_Y_PTM_SW.

721. The MBM of embodiment 618, wherein ABM2 comprises the heavy chain variable sequence and the light chain variable sequence of CD3_SP11A_VH5_VK2_S_PTM_SW.

722. The MBM of embodiment 618, wherein ABM2 comprises the heavy chain variable sequence and the light chain variable sequence of CD3_SP11A_VH5_VK2_PTM_SW.

723. The MBM of embodiment 618, wherein ABM2 comprises the heavy chain variable sequence and the light chain variable sequence of CD3_SP11A_VH5_VK2_SW.

724. The MBM of any one of embodiments 1 to 150, wherein the component of the TCR complex is TCR-$\alpha$, TCR-$\beta$, or a TCR-$\alpha$/$\beta$ dimer.

725. The MBM of embodiment 724, wherein the component of the TCR complex is TCR-$\alpha$.

726. The MBM of embodiment 724, wherein the component of the TCR complex is TCR-$\beta$.

727. The MBM of embodiment 724, wherein the component of the TCR complex is a TCR-$\alpha$/$\beta$ dimer.

728. The MBM of embodiment 724, wherein ABM2 comprises the CDR sequences of BMA031.

729. The MBM of embodiment 728, wherein the CDR sequences are defined by Kabat numbering.

730. The MBM of embodiment 728, wherein the CDR sequences are defined by Chothia numbering.

731. The MBM of embodiment 728, wherein the CDR sequences are defined by a combination of Kabat and Chothia numbering.

732. The MBM of embodiment 728, wherein ABM2 comprises the heavy and light chain variable sequences of BMA031.

733. The MBM of any one of embodiments 1 to 150, wherein the component of the TCR complex is TCR-γ, TCR-δ, or a TCR-γ/δ dimer.

734. The MBM of embodiment 733, wherein the component of the TCR complex is TCR-γ.

735. The MBM of embodiment 733, wherein the component of the TCR complex is TCR-γ/δ.

736. The MBM of embodiment 733, wherein the component of the TCR complex is a TCR-γ/δ dimer.

737. The MBM of embodiment 733, wherein ABM2 comprises the CDR sequences of δTCS1.

738. The MBM of embodiment 737, wherein the CDR sequences are defined by Kabat numbering.

739. The MBM of embodiment 737, wherein the CDR sequences are defined by Chothia numbering.

740. The MBM of embodiment 737, wherein the CDR sequences are defined by a combination of Kabat and Chothia numbering.

741. The MBM of embodiment 737, wherein ABM2 comprises the heavy and light chain variable sequences of δTCS1.

742. The MBM of any one of embodiments 1 to 741, wherein ABM3 binds specifically to human CD2.

743. The MBM of embodiment 742, wherein ABM3 is a non-immunoglobulin scaffold based ABM.

744. The MBM of embodiment 743, wherein ABM3 is a Kunitz domain, an Adnexin, an Affibody, a DARPin, an Avimer, an Anticalin, a Lipocalin, a Centyrin, a Versabody, a Knottin, an Adnectin, a Pronectin, an Affitin/Nanofitin, an Affilin, an Atrimer/Tetranectin, a bicyclic peptide, a cysknot, a Fn3 scaffold, an Obody, a Tn3, an Affimer, BD, an Adhiron, a Duocalin, an Alphabody, an Armadillo Repeat Protein, a Repebody, or a Fynomer.

745. The MBM of embodiment 743, wherein ABM3 comprises a receptor binding domain of a CD2 ligand.

746. The MBM of embodiment 745, wherein the CD2 ligand is CD58.

747. The MBM of embodiment 745, wherein the CD2 ligand is CD48.

748. The MBM of embodiment 745, wherein ABM3 is a CD58 moiety.

749. The MBM of embodiment 748, wherein the CD58 moiety comprises the amino acid sequence of CD58-1 as set forth in Table 15.

750. The MBM of embodiment 748, wherein the CD58 moiety comprises the amino acid sequence of CD58-2 as set forth in Table 15.

751. The MBM of embodiment 748, wherein the CD58 moiety comprises the amino acid sequence of CD58-3 as set forth in Table 15.

752. The MBM of embodiment 748, wherein the CD58 moiety comprises the amino acid sequence of CD58-4 as set forth in Table 15.

753. The MBM of embodiment 748, wherein the CD58 moiety comprises the amino acid sequence of CD58-5 as set forth in Table 15.

754. The MBM of embodiment 753, wherein the amino acid designated as B is a phenylalanine.

755. The MBM of embodiment 753, wherein the amino acid designated as B is a serine.

756. The MBM of any one of embodiments 753 to 755, wherein the amino acid designated as J is a valine.

757. The MBM of any one of embodiments 753 to 755, wherein the amino acid designated as J is a lysine.

758. The MBM of any one of embodiments 753 to 757, wherein the amino acid designated as O is a valine.

759. The MBM of any one of embodiments 753 to 757, wherein the amino acid designated as O is a glutamine.

760. The MBM of any one of embodiments 753 to 759, wherein the amino acid designated as U is a valine.

761. The MBM of any one of embodiments 753 to 759, wherein the amino acid designated as U is a lysine.

762. The MBM of any one of embodiments 753 to 761, wherein the amino acid designated as X is a threonine.

763. The MBM of any one of embodiments 753 to 761, wherein the amino acid designated as X is a serine.

764. The MBM of any one of embodiments 753 to 763, wherein the amino acid designated as Z is a leucine.

765. The MBM of any one of embodiments 753 to 763, wherein the amino acid designated as Z is a glycine.

766. The MBM of embodiment 748, wherein the CD58 moiety comprises the amino acid sequence of CD58-6 as set forth in Table 15.

767. The MBM of embodiment 748, wherein the CD58 moiety comprises the amino acid sequence of CD58-7 as set forth in Table 15.

768. The MBM of embodiment 767, wherein the amino acid designated as J is a valine.

769. The MBM of embodiment 767, wherein the amino acid designated as J is a lysine.

770. The MBM of any one of embodiments 767 to 769, wherein the amino acid designated as O is a valine.

771. The MBM of any one of embodiments 767 to 769, wherein the amino acid designated as O is a glutamine.

772. The MBM of embodiment 748, wherein the CD58 moiety comprises the amino acid sequence of CD58-8 as set forth in Table 15.

773. The MBM of embodiment 748, wherein the CD58 moiety comprises the amino acid sequence of CD58-9 as set forth in Table 15.

774. The MBM of embodiment 748, wherein the CD58 moiety comprises the amino acid sequence of CD58-10 as set forth in Table 15.

775. The MBM of embodiment 748, wherein the CD58 moiety comprises the amino acid sequence of CD58-11 as set forth in Table 15.

776. The MBM of embodiment 745, wherein ABM3 is a CD48 moiety.

777. The MBM of embodiment 776, wherein the CD48 moiety has at least 70% sequence identity to amino acids 27-220 of the amino acid sequence of Uniprot identifier P09326.

778. The MBM of embodiment 776, wherein the CD48 moiety has at least 80% sequence identity to amino acids 27-220 of the amino acid sequence of Uniprot identifier P09326.

779. The MBM of embodiment 776, wherein the CD48 moiety has at least 90% sequence identity to amino acids 27-220 of the amino acid sequence of Uniprot identifier P09326.

780. The MBM of embodiment 776, wherein the CD48 moiety has at least 95% sequence identity to amino acids 27-220 of the amino acid sequence of Uniprot identifier P09326.

781. The MBM of embodiment 776, wherein the CD48 moiety has at least 99% sequence identity to amino acids 27-220 of the amino acid sequence of Uniprot identifier P09326.

782. The MBM of embodiment 742, wherein ABM3 is an immunoglobulin scaffold based ABM.

783. The MBM of embodiment 782, wherein ABM3 is an antibody, an antibody fragment, an scFv, a dsFv, a Fv, a Fab, an scFab, a (Fab')2, a single domain antibody (SDAB), a VH or VL domain, or a camelid VHH domain.

784. The MBM of embodiment 783, wherein ABM3 is an antibody or an antigen-binding domain thereof.

785. The MBM of embodiment 783, wherein ABM3 is an scFv.

786. The MBM of embodiment 783, wherein ABM3 is a Fab.

787. The MBM of embodiment 786, wherein ABM3 is a Fab heterodimer.

788. The MBM of any one of embodiments 782 to 787, wherein ABM3 comprises the CDR sequences of CD2-1.

789. The MBM of embodiment 788, wherein ABM3 comprises the heavy and light chain variable sequences of CD2-1.

790. The MBM of embodiment 788, wherein ABM3 comprises the heavy and light chain variable sequences of hu1CD2-1.

791. The MBM of embodiment 788, wherein ABM3 comprises the heavy and light chain variable sequences of hu2CD2-1.

792. The MBM of embodiment 788, wherein ABM3 comprises the CDR sequences of Medi 507.

793. The MBM of embodiment 792, wherein ABM3 comprises the heavy and light chain variable sequences of Medi 507.

794. The MBM of any one of embodiments 1 to 741, wherein ABM3 binds specifically to a human TAA.

795. The MBM of embodiment 794, wherein ABM3 is a non-immunoglobulin scaffold based ABM.

796. The MBM of embodiment 795, wherein if TAA is a receptor, ABM3 comprises a receptor binding domain of a ligand of the receptor, and if TAA is a ligand, ABM3 comprises a ligand binding domain of a receptor of the ligand.

797. The MBM of embodiment 795, wherein ABM1 is a Kunitz domain, an Adnexin, an Affibody, a DARPin, an Avimer, an Anticalin, a Lipocalin, a Centyrin, a Versabody, a Knottin, an Adnectin, a Pronectin, an Affitin/Nanofitin, an Affilin, an Atrimer/Tetranectin, a bicyclic peptide, a cys-knot, a Fn3 scaffold, an Obody, a Tn3, an Affimer, BD, an Adhiron, a Duocalin, an Alphabody, an Armadillo Repeat Protein, a Repebody, or a Fynomer.

798. The MBM of embodiment 794, wherein ABM3 is an immunoglobulin scaffold based ABM.

799. The MBM of embodiment 798, wherein ABM3 is an antibody, an antibody fragment, an scFv, a dsFv, a Fv, a Fab, an scFab, a (Fab')2, a single domain antibody (SDAB), a VH or VL domain, or a camelid VHH domain.

800. The MBM of embodiment 799, wherein ABM3 is an antibody or an antigen-binding domain thereof.

801. The MBM of embodiment 799, wherein ABM3 is an scFv.

802. The MBM of embodiment 799, wherein ABM3 is a Fab.

803. The MBM of embodiment 802, wherein ABM3 is a Fab heterodimer.

804. The MBM of embodiments 794 to 803, wherein the TAA is a TAA expressed on cancerous B cells that are B cell-derived plasma cells.

805. The MBM of embodiments 794 to 803, wherein the TAA is a TAA expressed on cancerous B cells that are not plasma cells.

806. The MBM of embodiments 794 to 805, wherein the TAA is selected from CD19, CD20, CD22, CD123, CD33, CLL1, CD138, CS1, CD38, CD133, FLT3, CD52, TNFRSF13C, TNFRSF13B, CXCR4, PD-L1, LY9, CD200, FCGR2B, CD21, CD23, CD24, CD40L, CD72, CD79a, and CD79b.

807. The MBM of embodiment 806, wherein the TAA is CD19.

808. The MBM of embodiment 806, wherein the TAA is CD20.

809. The MBM of embodiment 806, wherein the TAA is CD22.

810. The MBM of embodiment 806, wherein the TAA is CD123.

811. The MBM of embodiment 806, wherein the TAA is CD33.

812. The MBM of embodiment 806, wherein the TAA is CLL1.

813. The MBM of embodiment 806, wherein the TAA is CD138.

814. The MBM of embodiment 806, wherein the TAA is CS1.

815. The MBM of embodiment 806, wherein the TAA is CD38.

816. The MBM of embodiment 806, wherein the TAA is CD133.

817. The MBM of embodiment 806, wherein the TAA is FLT3.

818. The MBM of embodiment 806, wherein the TAA is CD52.

819. The MBM of embodiment 806, wherein the TAA is TNFRSF13C.

820. The MBM of embodiment 806, wherein the TAA is TNFRSF13B.

821. The MBM of embodiment 806, wherein the TAA is CXCR4.

822. The MBM of embodiment 806, wherein the TAA is PD-L1.

823. The MBM of embodiment 806, wherein the TAA is LY9.

824. The MBM of embodiment 806, wherein the TAA is CD200.

825. The MBM of embodiment 806, wherein the TAA is FCGR2B.

826. The MBM of embodiment 806, wherein the TAA is CD21.

827. The MBM of embodiment 806, wherein the TAA is CD23.

828. The MBM of embodiment 806, wherein the TAA is CD24.

829. The MBM of embodiment 806, wherein the TAA is CD40L.

830. The MBM of embodiment 806, wherein the TAA is CD72.

831. The MBM of embodiment 806, wherein the TAA is CD79a.

832. The MBM of embodiment 806, wherein the TAA is CD79b.

833. The MBM of embodiment 807, wherein ABM3 comprises:
  (a) a CDR-H1 having the amino acid sequence of the CDR designated as CD19-H1;
  (b) a CDR-H2 having the amino acid sequence of any one of the CDRs designated as CD19-H2A, HD19-H2B, CD19-H2C and CD19-H2D;
  (c) a CDR-H3 having the amino acid sequence of the CDR designated as CD19-H3;
  (d) a CDR-L1 having the amino acid sequence of the CDR designated as CD19-L1;
  (e) a CDR-L2 having the amino acid sequence of the CDR designated as CD19-L2; and
  (f) a CDR-L3 having the amino acid sequence of the CDR designated as CD19-L23.

834. The MBM of embodiment 833, wherein ABM3 comprises:
  (a) a VH having the amino acid sequence of any one of the VH's designated as CD19-VHA, CD19-VHB, CD19-VHC, and CD19-VHD; and
  (b) a VL having the amino acid sequence of any one of the VL's designated as CD19-VLA and CD19-VLB.

835. The MBM of embodiment 807, wherein ABM3 comprises heavy chain CDRs having the amino acid sequences of CD19-H1, CD19-H2A, and CD19-H3 as set forth in Table 17 and light chain CDRs having the amino acid sequences of CD19-L1, CD19-L2, and CD19-L3 as set forth in Table 17.

836. The MBM of embodiment 807, wherein ABM3 comprises a heavy chain variable region having the amino acid sequences of VHA as set forth in Table 17 and a light chain variable region having the amino acid sequences of VLA as set forth in Table 17.

837. The MBM of embodiment 807, wherein ABM3 comprises heavy chain CDRs having the amino acid sequences of CD19-H1, CD19-H2B, and CD19-H3 as set forth in Table 17 and light chain CDRs having the amino acid sequences of CD19-L1, CD19-L2, and CD19-L3 as set forth in Table 17.

838. The MBM of embodiment 807, wherein ABM3 comprises a heavy chain variable region having the amino acid sequences of VHB as set forth in Table 17 and a light chain variable region having the amino acid sequences of VLB as set forth in Table 17.

839. The MBM of embodiment 807, wherein ABM3 comprises heavy chain CDRs having the amino acid sequences of CD19-H1, CD19-H2C, and CD19-H3 as set forth in Table 17 and light chain CDRs having the amino acid sequences of CD19-L1, CD19-L2, and CD19-L3 as set forth in Table 17.

840. The MBM of embodiment 807, wherein ABM3 comprises a heavy chain variable region having the amino acid sequences of VHC as set forth in Table 17 and a light chain variable region having the amino acid sequences of VLB as set forth in Table 2.

841. The MBM of embodiment 807, wherein ABM3 comprises heavy chain CDRs having the amino acid sequences of CD19-H1, CD19-H2D, and CD19-H3 as set forth in Table 17 and light chain CDRs having the amino acid sequences of CD19-L1, CD19-L2, and CD19-L3 as set forth in Table 17.

842. The MBM of embodiment 807, wherein ABM3 comprises a heavy chain variable region having the amino acid sequences of VHD as set forth in Table 17 and a light chain variable region having the amino acid sequences of VLB as set forth in Table 17.

843. The MBM of embodiment 807, wherein ABM3 comprises a scFv comprising the amino acid sequence of CD19-scFv1 as set forth in Table 17.

844. The MBM of embodiment 807, wherein ABM3 comprises a scFv comprising the amino acid sequence of CD19-scFv2 as set forth in Table 17.

845. The MBM of embodiment 807, wherein ABM3 comprises a scFv comprising the amino acid sequence of CD19-scFv3 as set forth in Table 17.

846. The MBM of embodiment 807, wherein ABM3 comprises a scFv comprising the amino acid sequence of CD19-scFv4 as set forth in Table 17.

847. The MBM of embodiment 807, wherein ABM3 comprises a scFv comprising the amino acid sequence of CD19-scFv5 as set forth in Table 17.

848. The MBM of embodiment 807, wherein ABM3 comprises a scFv comprising the amino acid sequence of CD19-scFv6 as set forth in Table 17.

849. The MBM of embodiment 807, wherein ABM3 comprises a scFv comprising the amino acid sequence of CD19-scFv7 as set forth in Table 17.

850. The MBM of embodiment 807, wherein ABM3 comprises a scFv comprising the amino acid sequence of CD19-scFv8 as set forth in Table 17.

851. The MBM of embodiment 807, wherein ABM3 comprises a scFv comprising the amino acid sequence of CD19-scFv9 as set forth in Table 17.

852. The MBM of embodiment 807, wherein ABM3 comprises a scFv comprising the amino acid sequence of CD19-scFv10 as set forth in Table 17.

853. The MBM of embodiment 807, wherein ABM3 comprises a scFv comprising the amino acid sequence of CD19-scFv11 as set forth in Table 17.

854. The MBM of embodiment 807, wherein ABM3 comprises a scFv comprising the amino acid sequence of CD19-scFv12 as set forth in Table 17.

855. The MBM of any one of embodiments 798 to 803, wherein ABM3 comprises a binding sequence described in Table 16.

856. The MBM of embodiment 855, wherein ABM3 comprises the CDRs or variable region sequences of the antibodies set forth in Table 16.

857. The MBM of any one of embodiments 1 to 856, which comprises a first variant Fc region and a second variant Fc region that together form an Fc heterodimer.

858. The MBM of embodiment 857, wherein the first and second variant Fc regions comprise the amino acid substitutions S364K/E357Q:L368D/K370S.

859. The MBM of embodiments 857, wherein the first and second variant Fc regions comprise the amino acid substitutions L368D/K370S:S364K.

860. The MBM of embodiment 857, wherein the first and second variant Fc regions comprise the amino acid substitutions L368E/K370S:S364K.

861. The MBM of embodiment 857, wherein the first and second variant Fc regions comprise the amino acid substitutions T411T/E360E/Q362E:D401K.

862. The MBM of embodiment 857, wherein the first and second variant Fc regions comprise the amino acid substitutions L368D 370S:S364/E357L.

863. The MBM of embodiment 857, wherein the first and second variant Fc regions comprise the amino acid substitutions 370S:S364K/E357Q.

864. The MBM of embodiment 857, wherein the first and second variant Fc regions comprise the amino acid substitutions of any one of the steric variants listed in FIG. 4 of WO 2014/110601 (reproduced in Table 3).

865. The MBM of embodiment 857, wherein the first and second variant Fc regions comprise the amino acid substitutions of any one of the variants listed in FIG. 5 of WO 2014/110601 (reproduced in Table 3).

866. The MBM of embodiment 857, wherein the first and second variant Fc regions comprise the amino acid substitutions of any one of the variants listed in FIG. 6 of WO 2014/110601 (reproduced in Table 3).

867. The MBM of any one of embodiments 857 to 866, wherein at least one of the Fc regions comprises an ablation variant modification.

868. The MBM of embodiment 867, wherein the ablation variant modifications are selected from Table 2.

869. The MBM of embodiment 868, wherein the ablation variant modification comprises G236R.

870. The MBM of embodiment 868, wherein the ablation variant modification comprises S239G.

871. The MBM of embodiment 868, wherein the ablation variant modification comprises S239K.

872. The MBM of embodiment 868, wherein the ablation variant modification comprises S239Q.

873. The MBM of embodiment 868, wherein the ablation variant modification comprises S239R.

874. The MBM of embodiment 868, wherein the ablation variant modification comprises V266D.

875. The MBM of embodiment 868, wherein the ablation variant modification comprises S267K.

876. The MBM of embodiment 868, wherein the ablation variant modification comprises S267R.

877. The MBM of embodiment 868, wherein the ablation variant modification comprises H268K.

878. The MBM of embodiment 868, wherein the ablation variant modification comprises E269R.

879. The MBM of embodiment 868, wherein the ablation variant modification comprises 299R.

880. The MBM of embodiment 868, wherein the ablation variant modification comprises 299K 881. The MBM of embodiment 868, wherein the ablation variant modification comprises K322A 882. The MBM of embodiment 868, wherein the ablation variant modification comprises A327G 883. The MBM of embodiment 868, wherein the ablation variant modification comprises A327L 884. The MBM of embodiment 868, wherein the ablation variant modification comprises A327N 885. The MBM of embodiment 868, wherein the ablation variant modification comprises A327Q 886. The MBM of embodiment 868, wherein the ablation variant modification comprises L328E 887. The MBM of embodiment 868, wherein the ablation variant modification comprises L328R 888. The MBM of embodiment 868, wherein the ablation variant modification comprises P329A 889. The MBM of embodiment 868, wherein the ablation variant modification comprises P329H 890. The MBM of embodiment 868, wherein the ablation variant modification comprises P329K 891. The MBM of embodiment 868, wherein the ablation variant modification comprises A330L 892. The MBM of embodiment 868, wherein the ablation variant modification comprises A330S/P331S 893. The MBM of embodiment 868, wherein the ablation variant modification comprises I332K 894. The MBM of embodiment 868, wherein the ablation variant modification comprises I332R 895. The MBM of embodiment 868, wherein the ablation variant modification comprises V266D/A327Q 896. The MBM of embodiment 868, wherein the ablation variant modification comprises V266D/P329K 897. The MBM of embodiment 868, wherein the ablation variant modification comprises G236R/L328R 898. The MBM of embodiment 868, wherein the ablation variant modification comprises E233P/L234V/L235A/G236del/S239K.

899. The MBM of embodiment 868, wherein the ablation variant modification comprises E233P/L234V/L235A/G236del/S267K.

900. The MBM of embodiment 868, wherein the ablation variant modification comprises E233P/L234V/L235A/G236del/S239K/A327G.

901. The MBM of embodiment 868, wherein the ablation variant modification comprises E233P/L234V/L235A/G236del/S267K/A327G.

902. The MBM of embodiment 868, wherein the ablation variant modification comprises E233P/L234V/L235A/G236del.

903. The MBM of embodiment 868, wherein the ablation variant modification comprises S239K/S267K.

904. The MBM of embodiment 868, wherein the ablation variant modification comprises 267K/P329K.

905. The MBM of embodiment 868, wherein the ablation variant modification comprises D265A/N297A/P329A.

906. The MBM of embodiment 868, wherein the ablation variant modification comprises D265N/N297D/P329G.

907. The MBM of embodiment 868, wherein the ablation variant modification comprises D265E/N297Q/P329S.

908. The MBM of any one of embodiments 867 to 907, wherein the Fc region comprising the ablation variant modification is operably linked to ABM1.

909. The MBM of any one of embodiments 867 to 907, wherein the Fc region comprising the ablation variant modification is operably linked to ABM2.

910. The MBM of any one of embodiments 867 to 907, wherein the Fc region comprising the ablation variant modification is operably linked to ABM3.

911. The MBM of any one of embodiments 867 to 907, wherein both variant Fc regions comprise the ablation variant modification.

912. The MBM of any one of embodiments 857 to 911, wherein at least one of the Fc regions further comprises pI variant substitutions.

913. The MBM of embodiment 912 wherein the pI variant substitutions are selected from Table 3.

914. The MBM of embodiment 913, wherein the pI variant substitutions comprise the substitutions present in pI_ISO(−).

915. The MBM of embodiment 913, wherein the pI variant substitutions comprise the substitutions present in pI_(−)_isosteric_A.

916. The MBM of embodiment 913, wherein the pI variant substitutions comprise the substitutions present in pI_(−)_isosteric_B.

917. The MBM of embodiment 913, wherein the pI variant substitutions comprise the substitutions present in PI_ISO(+RR).

918. The MBM of embodiment 913, wherein the pI variant substitutions comprise the substitutions present in pI_ISO(+).

919. The MBM of embodiment 913, wherein the pI variant substitutions comprise the substitutions present in pI_(+)_isosteric_A.

920. The MBM of embodiment 913, wherein the pI variant substitutions comprise the substitutions present in pI_(+)_isosteric_B.

921. The MBM of embodiment 913, wherein the pI variant substitutions comprise the substitutions present in pI_(+)_isosteric_E269Q/E272Q.

922. The MBM of embodiment 913, wherein the pI variant substitutions comprise the substitutions present in pI_(+)_isosteric_E269Q/E283Q.

923. The MBM of embodiment 913, wherein the pI variant substitutions comprise the substitutions present in pI_(+)_isosteric_E2720/E283Q.

924. The MBM of embodiment 913, wherein the pI variant substitutions comprise the substitutions present in pI_(+)_isosteric_E269Q.

925. The MBM of any one of embodiments 857 to 924, wherein the first and/or second Fc region further comprises one or more amino acid substitution(s) selected from 434A, 434S, 428L, 308F, 259I, 428L, 434S, 259I/308F, 436I/428L, 436I or V, 434S, 436V, 428L, 252Y, 252Y, 254T, 256E, 259I/308F, 428L, 236A, 239D, 239E, 332E, 332D, 239D, 332E, 267D, 267E, 328F, 267E, 328F, 236A, 332E, 239D, 332E, 330Y, 239D, 332E, 330L, 236R, 328R, 236R, 328R, 236N, 267E, 243L, 298A and 299T.

926. The MBM of any one of embodiments 857 to 924, wherein the first and/or second Fc region further comprises the amino acid substitution 434A, 434S or 434V.

927. The MBM of embodiment 926, wherein the first and/or second Fc region further comprises the amino acid substitution 428L.

928. The MBM of any one of embodiments 926 to 927, wherein the first and/or second Fc region further comprises the amino acid substitution 308F.

929. The MBM of any one of embodiments 926 to 928, wherein the first and/or second Fc region further comprises the amino acid substitution 259I.

930. The MBM of any one of embodiments 926 to 929, wherein the first and/or second Fc region further comprises the amino acid substitution 436I.

931. The MBM of any one of embodiments 926 to 930, wherein the first and/or second Fc region further comprises the amino acid substitution 252Y.

932. The MBM of any one of embodiments 926 to 931, wherein the first and/or second Fc region further comprises the amino acid substitution 254T.

933. The MBM of any one of embodiments 926 to 932, wherein the first and/or second Fc region further comprises the amino acid substitution 256E.

934. The MBM of any one of embodiments 926 to 933, wherein the first and/or second Fc region further comprises the amino acid substitution 239D or 239E.

935. The MBM of any one of embodiments 926 to 934, wherein the first and/or second Fc region further comprises the amino acid substitution 332E or 332D.

936. The MBM of any one of embodiments 926 to 935, wherein the first and/or second Fc region further comprises the amino acid substitution 267D or 267E.

937. The MBM of any one of embodiments 926 to 936, wherein the first and/or second Fc region further comprises the amino acid substitution 330L.

938. The MBM of any one of embodiments 926 to 937, wherein the first and/or second Fc region further comprises the amino acid substitution 236R or 236N.

939. The MBM of any one of embodiments 926 to 938, wherein the first and/or second Fc region further comprises the amino acid substitution 328R.

940. The MBM of any one of embodiments 926 to 939, wherein the first and/or second Fc region further comprises the amino acid substitution 243L.

941. The MBM of any one of embodiments 926 to 940, wherein the first and/or second Fc region further comprises the amino acid substitution 298A.

942. The MBM of any one of embodiments 926 to 941, wherein the first and/or second Fc region further comprises the amino acid substitution 299T.

943. The MBM of embodiment 857, wherein:
   (a) the first and second variant Fc regions comprise the amino acid substitutions S364K/E357Q:L368D/K370S;
   (b) the first and/or second variant Fc regions comprises the ablation variant modifications E233P/L234V/L235A/G236del/S267K, and
   (c) the first and/or second variant Fc regions comprises the pI variant substitutions N208D/Q295E/N384D/Q418E/N421D (pI_(−)_isosteric_A).

944. The MBM of embodiment 943, wherein the first variant Fc region comprises the ablation variant modifications E233P/L234V/L235A/G236del/S267K.

945. The MBM of any one of embodiments 943 to 944, wherein the second variant Fc region comprises the ablation variant modifications E233P/L234V/L235A/G236del/S267K.

946. The MBM of any one of embodiments 943 to 945, wherein the first variant Fc region comprises the pI variant substitutions N208D/Q295E/N384D/Q418E/N421D (pI_(−)_isosteric_A).

947. The MBM of any one of embodiments 943 to 946, wherein the second variant Fc region comprises the pI variant substitutions N208D/Q295E/N384D/Q418E/N421D (pI_(−)_isosteric_A).

948. The MBM of any one of embodiments 857 to 947, wherein the first or second variant Fc region comprises an amino acid sequence which is at least 90% identical to SEQ ID NO:869.

949. The MBM of any one of embodiments 857 to 947, wherein the first or second variant Fc region comprises an amino acid sequence which is at least 95% identical to SEQ ID NO:869.

950. The MBM of any one of embodiments 857 to 947, wherein the first or second variant Fc region comprises the amino acid sequence of SEQ ID NO:869 modified with the substitutions recited in any one of embodiments 858 to 947.

951. The MBM of any one of embodiments 857 to 947, wherein the first or second variant Fc region comprises the amino acid sequence of SEQ ID NO:869 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 858 to 947.

952. The MBM of any one of 857 to 951, wherein the first or second variant Fc region comprises an amino acid sequence which is at least 90% identical to SEQ ID NO:870.

953. The MBM of any one of embodiments 857 to 951, wherein the first or second variant Fc region comprises an amino acid sequence which is at least 95% identical to SEQ ID NO:870.

954. The MBM of any one of embodiments 857 to 951, wherein the first or second variant Fc region comprises the amino acid sequence of SEQ ID NO:870 modified with the substitutions recited in any one of embodiments 858 to 947.

955. The MBM of any one of embodiments 857 to 951, wherein the first or second variant Fc region comprises the amino acid sequence of SEQ ID NO:870 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 858 to 947.

956. The MBM of any one of embodiments 857 to 951, wherein the first or second variant Fc region comprises an amino acid sequence which is at least 90% identical to SEQ ID NO:871.

957. The MBM of any one of embodiments 857 to 951, wherein the first or second variant Fc region comprises an amino acid sequence which is at least 95% identical to SEQ ID NO:871.

958. The MBM of any one of embodiments 857 to 951, wherein the first or second variant Fc region comprises the amino acid sequence of SEQ ID NO:871 modified with the substitutions recited in any one of embodiments 858 to 947.

959. The MBM of any one of embodiments 857 to 951, wherein the first or second variant Fc region comprises the amino acid sequence of SEQ ID NO:871 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 858 to 947.

960. The MBM of any one of embodiments 857 to 959, wherein the first or second variant Fc region comprises an amino acid sequence which is at least 90% identical to SEQ ID NO:872.

961. The MBM of any one of embodiments 857 to 959, wherein the first or second variant Fc region comprises an amino acid sequence which is at least 95% identical to SEQ ID NO:872.

962. The MBM of any one of embodiments 857 to 959, wherein the first or second variant Fc region comprises the amino acid sequence of SEQ ID NO:872 modified with the substitutions recited in any one of embodiments 858 to 947.

963. The MBM of any one of embodiments 857 to 959, wherein the first or second variant Fc region comprises the amino acid sequence of SEQ ID NO:872 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 858 to 947.

964. The MBM of any one of embodiments 1 to 856 which comprises an Fc domain.

965. The MBM of embodiment 964, wherein the Fc domain is an Fc heterodimer.

966. The MBM of embodiment 965, wherein the Fc heterodimer comprises any of the Fc modifications set forth in Table 3.

967. The MBM of embodiment 965, wherein the Fc heterodimer comprises knob-in-hole ("KIH") modifications.

968. The MBM of embodiment 967, wherein the KIH modifications are any of the KIH modifications described in Section 7.3.1.5.1 or in Table 3.

969. The MBM of embodiment 967, wherein the KIH modifications are any of the alternative KIH modifications described in Section 7.3.1.5.2 or in Table 3.

970. The MBM of any one of embodiments 965 to 969, which comprises polar bridge modifications.

971. The MBM of embodiment 970, wherein the polar bridge modifications are any of the polar bridge modifications described in Section 7.3.1.5.7 or in Table 3.

972. The MBM of any one of embodiments to 965 to 971, which comprises at least one of the Fc modifications designated as Fc 1 through Fc 150.

973. The MBM of embodiment 972, which comprises at least one of the Fc modifications designated as Fc 1 through Fc 5.

974. The MBM of embodiment 972, which comprises at least one of the Fc modifications designated as Fc 6 through Fc 10.

975. The MBM of embodiment 972, which comprises at least one of the Fc modifications designated as Fc 11 through Fc 15.

976. The MBM of embodiment 972, which comprises at least one of the Fc modifications designated as Fc 16 through Fc 20.

977. The MBM of embodiment 972, which comprises at least one of the Fc modifications designated as Fc 21 through Fc 25.

978. The MBM of embodiment 972, which comprises at least one of the Fc modifications designated as Fc 26 through Fc 30.

979. The MBM of embodiment 972, which comprises at least one of the Fc modifications designated as Fc 31 through Fc 35.

980. The MBM of embodiment 972, which comprises at least one of the Fc modifications designated as Fc 36 through Fc 40.

981. The MBM of embodiment 972, which comprises at least one of the Fc modifications designated as Fc 41 through Fc 45.

982. The MBM of embodiment 972, which comprises at least one of the Fc modifications designated as Fc 46 through Fc 50.

983. The MBM of embodiment 972, which comprises at least one of the Fc modifications designated as Fc 51 through Fc 55.

984. The MBM of embodiment 972, which comprises at least one of the Fc modifications designated as Fc 56 through Fc 60.

985. The MBM of embodiment 972, which comprises at least one of the Fc modifications designated as Fc 61 through Fc 65.

986. The MBM of embodiment 972, which comprises at least one of the Fc modifications designated as Fc 66 through Fc 70.

987. The MBM of embodiment 972, which comprises at least one of the Fc modifications designated as Fc 71 through Fc 75.

988. The MBM of embodiment 972, which comprises at least one of the Fc modifications designated as Fc 76 through Fc 80.

989. The MBM of embodiment 972, which comprises at least one of the Fc modifications designated as Fc 81 through Fc 85.

990. The MBM of embodiment 972, which comprises at least one of the Fc modifications designated as Fc 86 through Fc 90.

991. The MBM of embodiment 972, which comprises at least one of the Fc modifications designated as Fc 91 through Fc 95.

992. The MBM of embodiment 972, which comprises at least one of the Fc modifications designated as Fc 96 through Fc 100.

993. The MBM of embodiment 972, which comprises at least one of the Fc modifications designated as Fc 101 through Fc 105.

994. The MBM of embodiment 972, which comprises at least one of the Fc modifications designated as Fc 106 through Fc 110.

995. The MBM of embodiment 972, which comprises at least one of the Fc modifications designated as Fc 111 through Fc 115.

996. The MBM of embodiment 972, which comprises at least one of the Fc modifications designated as Fc 116 through Fc 120.

997. The MBM of embodiment 972, which comprises at least one of the Fc modifications designated as Fc 121 through Fc 125.

998. The MBM of embodiment 972, which comprises at least one of the Fc modifications designated as Fc 126 through Fc 130.

999. The MBM of embodiment 972, which comprises at least one of the Fc modifications designated as Fc 131 through Fc 135.

1000. The MBM of embodiment 972, which comprises at least one of the Fc modifications designated as Fc 136 through Fc 140.

1001. The MBM of embodiment 972, which comprises at least one of the Fc modifications designated as Fc 141 through Fc 145.

1002. The MBM of embodiment 972, which comprises at least one of the Fc modifications designated as Fc 146 through Fc 150.

1003. The MBM of any one of embodiments 964 to 1002, wherein the Fc domain has altered effector function.

1004. The MBM of embodiment 1003, wherein the Fc domain has altered binding to one or more Fc receptors.

1005. The MBM of embodiment 1004, wherein the one or more Fc receptors comprise FcRN.

1006. The MBM of embodiment 1004 or embodiment 1005, wherein the one or more Fc receptors comprise leukocyte receptors.

1007. The MBM of any one of embodiments 964 to 1006, wherein the Fc has modified disulfide bond architecture.

1008. The MBM of any one of embodiments 964 to 1007, wherein the Fc has altered glycosylation patterns.

1009. The MBM of any one of embodiments 964 to 1008, wherein the Fc comprises a hinge region.

1010. The MBM of embodiment 1009, wherein the hinge region comprises any one of the hinge regions described in Section 7.3.2.

1011. The MBM of embodiment 1010, wherein the hinge region comprises the amino acid sequence of the hinge region designated H1.

1012. The MBM of embodiment 1010, wherein the hinge region comprises the amino acid sequence of the hinge region designated H2.

1013. The MBM of embodiment 1010, wherein the hinge region comprises the amino acid sequence of the hinge region designated H3.

1014. The MBM of embodiment 1010, wherein the hinge region comprises the amino acid sequence of the hinge region designated H4.

1015. The MBM of embodiment 1010, wherein the hinge region comprises the amino acid sequence of the hinge region designated H5.

1016. The MBM of embodiment 1010, wherein the hinge region comprises the amino acid sequence of the hinge region designated H6.

1017. The MBM of embodiment 1010, wherein the hinge region comprises the amino acid sequence of the hinge region designated H7.

1018. The MBM of embodiment 1010, wherein the hinge region comprises the amino acid sequence of the hinge region designated H8.

1019. The MBM of embodiment 1010, wherein the hinge region comprises the amino acid sequence of the hinge region designated H9.

1020. The MBM of embodiment 1010, wherein the hinge region comprises the amino acid sequence of the hinge region designated H10.

1021. The MBM of embodiment 1010, wherein the hinge region comprises the amino acid sequence of the hinge region designated H11.

1022. The MBM of embodiment 1010, wherein the hinge region comprises the amino acid sequence of the hinge region designated H12.

1023. The MBM of embodiment 1010, wherein the hinge region comprises the amino acid sequence of the hinge region designated H13.

1024. The MBM of embodiment 1010, wherein the hinge region comprises the amino acid sequence of the hinge region designated H14.

1025. The MBM of embodiment 1010, wherein the hinge region comprises the amino acid sequence of the hinge region designated H15.

1026. The MBM of embodiment 1010, wherein the hinge region comprises the amino acid sequence of the hinge region designated H16.

1027. The MBM of embodiment 1010, wherein the hinge region comprises the amino acid sequence of the hinge region designated H17.

1028. The MBM of embodiment 1010, wherein the hinge region comprises the amino acid sequence of the hinge region designated H18.

1029. The MBM of embodiment 1010, wherein the hinge region comprises the amino acid sequence of the hinge region designated H19.

1030. The MBM of embodiment 1010, wherein the hinge region comprises the amino acid sequence of the hinge region designated H20.

1031. The MBM of embodiment 1010, wherein the hinge region comprises the amino acid sequence of the hinge region designated H21.

1032. The MBM of any one of embodiments 1 to 1031, which comprises at least one scFv domain.

1033. The MBM of embodiment 1032, wherein at least one scFv comprises a linker connecting the VH and VL domains.

1034. The MBM of embodiment 1033, wherein the linker is 5 to 25 amino acids in length.

1035. The MBM of embodiment 1034, wherein the linker is 12 to 20 amino acids in length.

1036. The MBM of any one of embodiments 1033 to 1035, wherein the linker is a charged linker and/or a flexible linker.

1037. The MBM of any one of embodiments 1033 to 1036, wherein the linker is selected from any one of linkers L1 through L54.

1038. The MBM of embodiment 1037, wherein the linker region comprises the amino acid sequence of the linker designated L1.

1039. The MBM of embodiment 1037, wherein the linker region comprises the amino acid sequence of the linker designated L2.

1040. The MBM of embodiment 1037, wherein the linker region comprises the amino acid sequence of the linker designated L3.

1041. The MBM of embodiment 1037, wherein the linker region comprises the amino acid sequence of the linker designated L4.

1042. The MBM of embodiment 1037, wherein the linker region comprises the amino acid sequence of the linker designated L5.

1043. The MBM of embodiment 1037, wherein the linker region comprises the amino acid sequence of the linker designated L6.

1044. The MBM of embodiment 1037, wherein the linker region comprises the amino acid sequence of the linker designated L7.

1045. The MBM of embodiment 1037, wherein the linker region comprises the amino acid sequence of the linker designated L8.

1046. The MBM of embodiment 1037, wherein the linker region comprises the amino acid sequence of the linker designated L9.

1047. The MBM of embodiment 1037, wherein the linker region comprises the amino acid sequence of the linker designated L10.

1048. The MBM of embodiment 1037, wherein the linker region comprises the amino acid sequence of the linker designated L11.

1049. The MBM of embodiment 1037, wherein the linker region comprises the amino acid sequence of the linker designated L12.

1050. The MBM of embodiment 1037, wherein the linker region comprises the amino acid sequence of the linker designated L13.

1051. The MBM of embodiment 1037, wherein the linker region comprises the amino acid sequence of the linker designated L14.

1052. The MBM of embodiment 1037, wherein the linker region comprises the amino acid sequence of the linker designated L15.

1053. The MBM of embodiment 1037, wherein the linker region comprises the amino acid sequence of the linker designated L16.

1054. The MBM of embodiment 1037, wherein the linker region comprises the amino acid sequence of the linker designated L17.

1055. The MBM of embodiment 1037, wherein the linker region comprises the amino acid sequence of the linker designated L18.

1056. The MBM of embodiment 1037, wherein the linker region comprises the amino acid sequence of the linker designated L19.

1057. The MBM of embodiment 1037, wherein the linker region comprises the amino acid sequence of the linker designated L20.

1058. The MBM of embodiment 1037, wherein the linker region comprises the amino acid sequence of the linker designated L21.

1059. The MBM of embodiment 1037, wherein the linker region comprises the amino acid sequence of the linker designated L22.

1060. The MBM of embodiment 1037, wherein the linker region comprises the amino acid sequence of the linker designated L23.

1061. The MBM of embodiment 1037, wherein the linker region comprises the amino acid sequence of the linker designated L24.

1062. The MBM of embodiment 1037, wherein the linker region comprises the amino acid sequence of the linker designated L25.

1063. The MBM of embodiment 1037, wherein the linker region comprises the amino acid sequence of the linker designated L26.

1064. The MBM of embodiment 1037, wherein the linker region comprises the amino acid sequence of the linker designated L27.

1065. The MBM of embodiment 1037, wherein the linker region comprises the amino acid sequence of the linker designated L28.

1066. The MBM of embodiment 1037, wherein the linker region comprises the amino acid sequence of the linker designated L29.

1067. The MBM of embodiment 1037, wherein the linker region comprises the amino acid sequence of the linker designated L30.

1068. The MBM of embodiment 1037, wherein the linker region comprises the amino acid sequence of the linker designated L31.

1069. The MBM of embodiment 1037, wherein the linker region comprises the amino acid sequence of the linker designated L32.

1070. The MBM of embodiment 1037, wherein the linker region comprises the amino acid sequence of the linker designated L33.

1071. The MBM of embodiment 1037, wherein the linker region comprises the amino acid sequence of the linker designated L34.

1072. The MBM of embodiment 1037, wherein the linker region comprises the amino acid sequence of the linker designated L35.

1073. The MBM of embodiment 1037, wherein the linker region comprises the amino acid sequence of the linker designated L36.

1074. The MBM of embodiment 1037, wherein the linker region comprises the amino acid sequence of the linker designated L37.

1075. The MBM of embodiment 1037, wherein the linker region comprises the amino acid sequence of the linker designated L38.

1076. The MBM of embodiment 1037, wherein the linker region comprises the amino acid sequence of the linker designated L39.

1077. The MBM of embodiment 1037, wherein the linker region comprises the amino acid sequence of the linker designated L40.

1078. The MBM of embodiment 1037, wherein the linker region comprises the amino acid sequence of the linker designated L41.

1079. The MBM of embodiment 1037, wherein the linker region comprises the amino acid sequence of the linker designated L42.

1080. The MBM of embodiment 1037, wherein the linker region comprises the amino acid sequence of the linker designated L43.

1081. The MBM of embodiment 1037, wherein the linker region comprises the amino acid sequence of the linker designated L44.

1082. The MBM of embodiment 1037, wherein the linker region comprises the amino acid sequence of the linker designated L45.

1083. The MBM of embodiment 1037, wherein the linker region comprises the amino acid sequence of the linker designated L46.

1084. The MBM of embodiment 1037, wherein the linker region comprises the amino acid sequence of the linker designated L47.

1085. The MBM of embodiment 1037, wherein the linker region comprises the amino acid sequence of the linker designated L48.

1086. The MBM of embodiment 1037, wherein the linker region comprises the amino acid sequence of the linker designated L49.

1087. The MBM of embodiment 1037, wherein the linker region comprises the amino acid sequence of the linker designated L50.

1088. The MBM of embodiment 1037, wherein the linker region comprises the amino acid sequence of the linker designated L51.

1089. The MBM of embodiment 1037, wherein the linker region comprises the amino acid sequence of the linker designated L52.

1090. The MBM of embodiment 1037, wherein the linker region comprises the amino acid sequence of the linker designated L53.

1091. The MBM of embodiment 1037, wherein the linker region comprises the amino acid sequence of the linker designated L54.

1092. The MBM of any one of embodiments 1 to 1091, which comprises at least one Fab domain.

1093. The MBM of embodiment 1092, wherein at least one Fab domain comprises any of the Fab heterodimerization modifications set forth in Table 1.

1094. The MBM of embodiment 1093, wherein at least one Fab domain comprises the Fab heterodimerization modifications designated as F1.

1095. The MBM of embodiment 1093, wherein at least one Fab domain comprises the Fab heterodimerization modifications designated as F2.

1096. The MBM of embodiment 1093, wherein at least one Fab domain comprises the Fab heterodimerization modifications designated as F3.

1097. The MBM of embodiment 1093, wherein at least one Fab domain comprises the Fab heterodimerization modifications designated as F4.

1098. The MBM of embodiment 1093, wherein at least one Fab domain comprises the Fab heterodimerization modifications designated as F5.

1099. The MBM of embodiment 1093, wherein at least one Fab domain comprises the Fab heterodimerization modifications designated as F6.

1100. The MBM of embodiment 1093, wherein at least one Fab domain comprises the Fab heterodimerization modifications designated as F7.

1101. The MBM of any one of embodiments 1 to 1100, which comprises at least two ABMs, an ABM and an ABM chain, or two ABM chains connected to one another via a linker.

1102. The MBM of embodiment 1101, wherein the linker is 5 to 25 amino acids in length.

1103. The MBM of embodiment 1102, wherein the linker is 12 to 20 amino acids in length.

1104. The MBM of any one of embodiments 1101 to 1103, wherein the linker is a charged linker and/or a flexible linker.

1105. The MBM of any one of embodiments 1101 to 1104, wherein the linker is selected from any one of linkers L1 through L54.

1106. The MBM of embodiment 1105, wherein the linker region comprises the amino acid sequence of the linker designated L1.

1107. The MBM of embodiment 1105, wherein the linker region comprises the amino acid sequence of the linker designated L2.

1108. The MBM of embodiment 1105, wherein the linker region comprises the amino acid sequence of the linker designated L3.

1109. The MBM of embodiment 1105, wherein the linker region comprises the amino acid sequence of the linker designated L4.

1110. The MBM of embodiment 1105, wherein the linker region comprises the amino acid sequence of the linker designated L5.

1111. The MBM of embodiment 1105, wherein the linker region comprises the amino acid sequence of the linker designated L6.

1112. The MBM of embodiment 1105, wherein the linker region comprises the amino acid sequence of the linker designated L7.

1113. The MBM of embodiment 1105, wherein the linker region comprises the amino acid sequence of the linker designated L8.

1114. The MBM of embodiment 1105, wherein the linker region comprises the amino acid sequence of the linker designated L9.

1115. The MBM of embodiment 1105, wherein the linker region comprises the amino acid sequence of the linker designated L10.

1116. The MBM of embodiment 1105, wherein the linker region comprises the amino acid sequence of the linker designated L11.

1117. The MBM of embodiment 1105, wherein the linker region comprises the amino acid sequence of the linker designated L12.

1118. The MBM of embodiment 1105, wherein the linker region comprises the amino acid sequence of the linker designated L13.

1119. The MBM of embodiment 1105, wherein the linker region comprises the amino acid sequence of the linker designated L14.

1120. The MBM of embodiment 1105, wherein the linker region comprises the amino acid sequence of the linker designated L15.

1121. The MBM of embodiment 1105, wherein the linker region comprises the amino acid sequence of the linker designated L16.

1122. The MBM of embodiment 1105, wherein the linker region comprises the amino acid sequence of the linker designated L17.

1123. The MBM of embodiment 1105, wherein the linker region comprises the amino acid sequence of the linker designated L18.

1124. The MBM of embodiment 1105, wherein the linker region comprises the amino acid sequence of the linker designated L19.

1125. The MBM of embodiment 1105, wherein the linker region comprises the amino acid sequence of the linker designated L20.

1126. The MBM of embodiment 1105, wherein the linker region comprises the amino acid sequence of the linker designated L21.

1127. The MBM of embodiment 1105, wherein the linker region comprises the amino acid sequence of the linker designated L22.

1128. The MBM of embodiment 1105, wherein the linker region comprises the amino acid sequence of the linker designated L23.

1129. The MBM of embodiment 1105, wherein the linker region comprises the amino acid sequence of the linker designated L24.

1130. The MBM of embodiment 1105, wherein the linker region comprises the amino acid sequence of the linker designated L25.

1131. The MBM of embodiment 1105, wherein the linker region comprises the amino acid sequence of the linker designated L26.

1132. The MBM of embodiment 1105, wherein the linker region comprises the amino acid sequence of the linker designated L27.

1133. The MBM of embodiment 1105, wherein the linker region comprises the amino acid sequence of the linker designated L28.

1134. The MBM of embodiment 1105, wherein the linker region comprises the amino acid sequence of the linker designated L29.

1135. The MBM of embodiment 1105, wherein the linker region comprises the amino acid sequence of the linker designated L30.

1136. The MBM of embodiment 1105, wherein the linker region comprises the amino acid sequence of the linker designated L31.

1137. The MBM of embodiment 1105, wherein the linker region comprises the amino acid sequence of the linker designated L32.

1138. The MBM of embodiment 1105, wherein the linker region comprises the amino acid sequence of the linker designated L33.

1139. The MBM of embodiment 1105, wherein the linker region comprises the amino acid sequence of the linker designated L34.

1140. The MBM of embodiment 1105, wherein the linker region comprises the amino acid sequence of the linker designated L35.

1141. The MBM of embodiment 1105, wherein the linker region comprises the amino acid sequence of the linker designated L36.

1142. The MBM of embodiment 1105, wherein the linker region comprises the amino acid sequence of the linker designated L37.

1143. The MBM of embodiment 1105, wherein the linker region comprises the amino acid sequence of the linker designated L38.

1144. The MBM of embodiment 1105, wherein the linker region comprises the amino acid sequence of the linker designated L39.

1145. The MBM of embodiment 1105, wherein the linker region comprises the amino acid sequence of the linker designated L40.

1146. The MBM of embodiment 1105, wherein the linker region comprises the amino acid sequence of the linker designated L41.

1147. The MBM of embodiment 1105, wherein the linker region comprises the amino acid sequence of the linker designated L42.

1148. The MBM of embodiment 1105, wherein the linker region comprises the amino acid sequence of the linker designated L43.

1149. The MBM of embodiment 1105, wherein the linker region comprises the amino acid sequence of the linker designated L44.

1150. The MBM of embodiment 1105, wherein the linker region comprises the amino acid sequence of the linker designated L45.

1151. The MBM of embodiment 1105, wherein the linker region comprises the amino acid sequence of the linker designated L46.

1152. The MBM of embodiment 1105, wherein the linker region comprises the amino acid sequence of the linker designated L47.

1153. The MBM of embodiment 1105, wherein the linker region comprises the amino acid sequence of the linker designated L48.

1154. The MBM of embodiment 1105, wherein the linker region comprises the amino acid sequence of the linker designated L49.

1155. The MBM of embodiment 1105, wherein the linker region comprises the amino acid sequence of the linker designated L50.

1156. The MBM of embodiment 1105, wherein the linker region comprises the amino acid sequence of the linker designated L51.

1157. The MBM of embodiment 1105, wherein the linker region comprises the amino acid sequence of the linker designated L52.

1158. The MBM of embodiment 1105, wherein the linker region comprises the amino acid sequence of the linker designated L53.

1159. The MBM of embodiment 1105, wherein the linker region comprises the amino acid sequence of the linker designated L54.

1160. The MBM of any one of embodiments 1 to 1159, which is a trivalent MBM.

1161. The MBM of embodiment 1160, wherein the trivalent MBM has any one of the configurations depicted in FIGS. 1B-1P.

1162. The MBM of embodiment 1161, wherein the trivalent MBM has the configuration depicted in FIG. 1B.

1163. The MBM of embodiment 1161, wherein the trivalent MBM has the configuration depicted in FIG. 1C.

1164. The MBM of embodiment 1161, wherein the trivalent MBM has the configuration depicted in FIG. 1D.

1165. The MBM of embodiment 1161, wherein the trivalent MBM has the configuration depicted in FIG. 1E.

1166. The MBM of embodiment 1161, wherein the trivalent MBM has the configuration depicted in FIG. 1F.

1167. The MBM of embodiment 1161, wherein the trivalent MBM has the configuration depicted in FIG. 1G.

1168. The MBM of embodiment 1161, wherein the trivalent MBM has the configuration depicted in FIG. 1H.

1169. The MBM of embodiment 1161, wherein the trivalent MBM has the configuration depicted in FIG. 1I.

1170. The MBM of embodiment 1161, wherein the trivalent MBM has the configuration depicted in FIG. 1J.

1171. The MBM of embodiment 1161, wherein the trivalent MBM has the configuration depicted in FIG. 1K.

1172. The MBM of embodiment 1161, wherein the trivalent MBM has the configuration depicted in FIG. 1L.

1173. The MBM of embodiment 1161, wherein the trivalent MBM has the configuration depicted in FIG. 1M.

1174. The MBM of embodiment 1161, wherein the trivalent MBM has the configuration depicted in FIG. 1N.

1175. The MBM of embodiment 1161, wherein the trivalent MBM has the configuration depicted in FIG. 1O.

1176. The MBM of embodiment 1161, wherein the trivalent MBM has the configuration depicted in FIG. 1P.

1177. The MBM of any one of embodiments 1161 to 1176, in which the ABMs have the configuration designated as T1.

1178. The MBM of any one of embodiments 1161 to 1176, in which the ABMs have the configuration designated as T2.

1179. The MBM of any one of embodiments 1161 to 1176, in which the ABMs have the configuration designated as T3.

1180. The MBM of any one of embodiments 1161 to 1176, in which the ABMs have the configuration designated as T4.

1181. The MBM of any one of embodiments 1161 to 1176, in which the ABMs have the configuration designated as T5.

1182. The MBM of any one of embodiments 1161 to 1176, in which the ABMs have the configuration designated as T6.

1183. The MBM of any one of embodiments 1 to 1159, which is a tetravalent MBM. 1184. The MBM of embodiment 1183, wherein the tetravalent MBM has any one of the configurations depicted in FIGS. 1Q-1S.

1185. The MBM of embodiment 1184, wherein the tetravalent MBM has the configuration depicted in FIG. 1Q.

1186. The MBM of embodiment 1184, wherein the tetravalent MBM has the configuration depicted in FIG. 1R.

1187. The MBM of embodiment 1184, wherein the tetravalent MBM has the configuration depicted in FIG. 1S.

1188. The MBM of any one of embodiments 1184 to 1187, in which the ABMs have any of one the configurations designated Tv 1 through Tv 24.

1189. The MBM of embodiment 1188, in which the ABMs have the configuration designated Tv 1.

1190. The MBM of embodiment 1188, in which the ABMs have the configuration designated Tv 2.

1191. The MBM of embodiment 1188, in which the ABMs have the configuration designated Tv 3.

1192. The MBM of embodiment 1188, in which the ABMs have the configuration designated Tv 4.

1193. The MBM of embodiment 1188, in which the ABMs have the configuration designated Tv 5.

1194. The MBM of embodiment 1188, in which the ABMs have the configuration designated Tv 6.

1195. The MBM of embodiment 1188, in which the ABMs have the configuration designated Tv 7.

1196. The MBM of embodiment 1188, in which the ABMs have the configuration designated Tv 8.

1197. The MBM of embodiment 1188, in which the ABMs have the configuration designated Tv 9.

1198. The MBM of embodiment 1188, in which the ABMs have the configuration designated Tv 10.

1199. The MBM of embodiment 1188, in which the ABMs have the configuration designated Tv 11.

1200. The MBM of embodiment 1188, in which the ABMs have the configuration designated Tv 12.

1201. The MBM of embodiment 1188, in which the ABMs have the configuration designated Tv 13.

1202. The MBM of embodiment 1188, in which the ABMs have the configuration designated Tv 14.

1203. The MBM of embodiment 1188, in which the ABMs have the configuration designated Tv 15.

1204. The MBM of embodiment 1188, in which the ABMs have the configuration designated Tv 16.

1205. The MBM of embodiment 1188, in which the ABMs have the configuration designated Tv 17.

1206. The MBM of embodiment 1188, in which the ABMs have the configuration designated Tv 18.

1207. The MBM of embodiment 1188, in which the ABMs have the configuration designated Tv 19.

1208. The MBM of embodiment 1188, in which the ABMs have the configuration designated Tv 20.

1209. The MBM of embodiment 1188, in which the ABMs have the configuration designated Tv 21.

1210. The MBM of embodiment 1188, in which the ABMs have the configuration designated Tv 22.

1211. The MBM of embodiment 1188, in which the ABMs have the configuration designated Tv 23.

1212. The MBM of embodiment 1188, in which the ABMs have the configuration designated Tv 24

1213. The MBM of any one of embodiments 1 to 1159, which is a pentavalent MBM.

1214. The MBM of embodiment 1213, wherein the pentavalent MBM has the configuration depicted in FIG. 1T.

1215. The MBM of embodiment 1214, in which the ABMs have any one of the configurations designated Pv 1 through Pv 80.

1216. The MBM of embodiment 1215, in which the ABMs have a configuration selected from any one of the configurations designated Pv 1 through Pv 10.

1217. The MBM of embodiment 1215, in which the ABMs have a configuration selected from any one of the configurations designated Pv 11 through Pv 20.

1218. The MBM of embodiment 1215, in which the ABMs have a configuration selected from any one of the configurations designated Pv 21 through Pv 30.

1219. The MBM of embodiment 1215, in which the ABMs have a configuration selected from any one of the configurations designated Pv 31 through Pv 40.

1220. The MBM of embodiment 1215, in which the ABMs have a configuration selected from any one of the configurations designated Pv 41 through Pv 50.

1221. The MBM of embodiment 1215, in which the ABMs have a configuration selected from any one of the configurations designated Pv 51 through Pv 60.

1222. The MBM of embodiment 1215, in which the ABMs have a configuration selected from any one of the configurations designated Pv 61 through Pv 70.

1223. The MBM of embodiment 1215, in which the ABMs have a configuration selected from any one of the configurations designated Pv 71 through Pv 80.

1224. The MBM of embodiment 1215, in which the ABMs have a configuration selected from any one of the configurations designated Pv 81 through Pv 90.

1225. The MBM of embodiment 1215, in which the ABMs have a configuration selected from any one of the configurations designated Pv 91 through Pv 100.

1226. The MBM of any one of embodiments 1 to 1159, which is a hexavalent MBM. 1227. The MBM of embodiment 1226, wherein the hexavalent MBM has the configuration depicted in FIG. 1U or FIG. 1V.

1228. The MBM of embodiment 1227, wherein the hexavalent MBM has the configuration depicted in FIG. 1U.

1229. The MBM of embodiment 1227, wherein the hexavalent MBM has the configuration depicted in FIG. 1V.

1230. The MBM of any one of embodiments 1227 to 1229, in which the ABMs have any one of the configurations designated Hv 1 through Hv 330.

1231. The MBM of embodiment 1230, in which the ABMs have a configuration selected from any one of the configurations designated Hv 1 through Hv 10.

1232. The MBM of embodiment 1230, in which the ABMs have a configuration selected from any one of the configurations designated Hv 11 through Hv 20.

1233. The MBM of embodiment 1230, in which the ABMs have a configuration selected from any one of the configurations designated Hv 21 through Hv 30.

1234. The MBM of embodiment 1230, in which the ABMs have a configuration selected from any one of the configurations designated Hv 31 through Hv 40.

1235. The MBM of embodiment 1230, in which the ABMs have a configuration selected from any one of the configurations designated Hv 41 through Hv 50.

1236. The MBM of embodiment 1230, in which the ABMs have a configuration selected from any one of the configurations designated Hv 51 through Hv 60.

1237. The MBM of embodiment 1230, in which the ABMs have a configuration selected from any one of the configurations designated Hv 61 through Hv 70.

1238. The MBM of embodiment 1230, in which the ABMs have a configuration selected from any one of the configurations designated Hv 71 through Hv 80.

1239. The MBM of embodiment 1230, in which the ABMs have a configuration selected from any one of the configurations designated Hv 81 through Hv 90.

1240. The MBM of embodiment 1230, in which the ABMs have a configuration selected from any one of the configurations designated Hv 91 through Hv 100.

1241. The MBM of embodiment 1230, in which the ABMs have a configuration selected from any one of the configurations designated Hv 101 through Hv 110.

1242. The MBM of embodiment 1230, in which the ABMs have a configuration selected from any one of the configurations designated Hv 111 through Hv 120.

1243. The MBM of embodiment 1230, in which the ABMs have a configuration selected from any one of the configurations designated Hv 121 through Hv 130.

1244. The MBM of embodiment 1230, in which the ABMs have a configuration selected from any one of the configurations designated Hv 131 through Hv 140.

1245. The MBM of embodiment 1230, in which the ABMs have a configuration selected from any one of the configurations designated Hv 141 through Hv 150.

1246. The MBM of embodiment 1230, in which the ABMs have a configuration selected from any one of the configurations designated Hv 151 through Hv 160.

1247. The MBM of embodiment 1230, in which the ABMs have a configuration selected from any one of the configurations designated Hv 161 through Hv 70.

1248. The MBM of embodiment 1230, in which the ABMs have a configuration selected from any one of the configurations designated Hv 171 through Hv 80.

1249. The MBM of embodiment 1230, in which the ABMs have a configuration selected from any one of the configurations designated Hv 181 through Hv 90.

1250. The MBM of embodiment 1230, in which the ABMs have a configuration selected from any one of the configurations designated Hv 191 through Hv 200.

1251. The MBM of embodiment 1230, in which the ABMs have a configuration selected from any one of the configurations designated Hv 201 through Hv 210.

1252. The MBM of embodiment 1230, in which the ABMs have a configuration selected from any one of the configurations designated Hv 211 through Hv 220.

1253. The MBM of embodiment 1230, in which the ABMs have a configuration selected from any one of the configurations designated Hv 221 through Hv 230.

1254. The MBM of embodiment 1230, in which the ABMs have a configuration selected from any one of the configurations designated Hv 231 through Hv 240.

1255. The MBM of embodiment 1230, in which the ABMs have a configuration selected from any one of the configurations designated Hv 241 through Hv 250.

1256. The MBM of embodiment 1230, in which the ABMs have a configuration selected from any one of the configurations designated Hv 251 through Hv 260.

1257. The MBM of embodiment 1230, in which the ABMs have a configuration selected from any one of the configurations designated Hv 261 through Hv 270.

1258. The MBM of embodiment 1230, in which the ABMs have a configuration selected from any one of the configurations designated Hv 271 through Hv 280.

1259. The MBM of embodiment 1230, in which the ABMs have a configuration selected from any one of the configurations designated Hv 281 through Hv 290.

1260. The MBM of embodiment 1230, in which the ABMs have a configuration selected from any one of the configurations designated Hv 291 through Hv 300.

1261. The MBM of embodiment 1230, in which the ABMs have a configuration selected from any one of the configurations designated Hv 301 through Hv 310.

1262. The MBM of embodiment 1230, in which the ABMs have a configuration selected from any one of the configurations designated Hv 311 through Hv 320.

1263. The MBM of embodiment 1230, in which the ABMs have a configuration selected from any one of the configurations designated Hv 321 through Hv 330.

1264. The MBM of any one of embodiments 1 to 1263, wherein each antigen-binding module is capable of binding its respective target at the same time as each of the other antigen-binding modules is bound to its respective target.

1265. The MBM of any one of embodiments 1 to 1264, wherein any one, any two, or all three of ABM1, ABM2 and ABM3 has cross-species reactivity.

1266. The MBM of embodiment 1265, wherein ABM1 further binds specifically to BCMA in one or more non-human mammalian species.

1267. The MBM of embodiment 1265 or embodiment 1266, wherein ABM2 further binds specifically to the component of a TCR complex in one or more non-human mammalian species.

1268. The MBM of any one of embodiments 1264 to 1267, wherein ABM3 further binds specifically to CD2 or the TAA in one or more non-human mammalian species.

1269. The MBM of any one of embodiments 1265 to 1268, wherein the one or more non-human mammalian species comprises one or more non-human primate species.

1270. The MBM of embodiment 1269, wherein the one or more non-human primate species comprises *Macaca fascicularis*.

1271. The MBM of embodiment 1269, wherein the one or more non-human primate species comprises *Macaca mulatta*.

1272. The MBM of embodiment 1269, wherein the one or more non-human primate species comprises *Macaca nemestrina*.

1273. The MBM of any one of embodiments 1265 to 1272, wherein the one or more non-human mammalian species comprises *Mus musculus*.

1274. The MBM of any one of embodiments 1 to 1273, wherein any one, any two, or all three of ABM1, ABM2 and ABM3 does not have cross-species reactivity.

1275. The MBM of any one of embodiments 1 to 1274, which has been recombinantly produced, optionally in a mammalian host cell, which is optionally selected from Vero cells, HeLa cells, COS cells, CHO cells, HEK293 cells, BHK cells and MDCKII cells.

1276. The MBM of any one of embodiments 1 to 1275, wherein the MBM is a trispecific binding molecule (TBM).

1277. The MBM of any one of embodiments 1 to 1276 for use as a medicament.

1278. The MBM of any one of embodiments 1 1276 for use in treating a disease or disorder associated with expression of BCMA.

1279. The MBM of embodiment 1278, wherein the disease or disorder comprises a cancer.

1280. The MBM of embodiment 1279, wherein the cancer comprises a B cell malignancy.

1281. The MBM of embodiment 1280, wherein the B cell malignancy is selected from Hodgkin's lymphoma, non-Hodgkin's lymphoma and multiple myeloma.

1282. The MBM of embodiment 1279, wherein the cancer is Hodgkin's lymphoma.

1283. The MBM of embodiment 1282, wherein the Hodgkin's lymphoma is nodular sclerosing Hodgkin's lymphoma.

1284. The MBM of embodiment 1282, wherein the Hodgkin's lymphoma is mixed-cellularity subtype Hodgkin's lymphoma.

1285. The MBM of embodiment 1282, wherein the Hodgkin's lymphoma is lymphocyte-rich or lymphocytic predominance Hodgkin's lymphoma.

1286. The MBM of embodiment 1282, wherein the Hodgkin's lymphoma is lymphocyte depleted Hodgkin's lymphoma.

1287. The MBM of embodiment 1279, wherein the cancer is non-Hodgkin's lymphoma.

1288. The MBM of embodiment 1287, wherein the non-Hodgkin's lymphoma is a B cell lymphoma or a T cell lymphoma.

1289. The MBM of embodiment 1287, wherein the non-Hodgkin's lymphoma is a B cell lymphoma.

1290. The MBM of embodiment 1287, wherein the non-Hodgkin's lymphoma is diffuse large B-cell lymphoma (DLBCL), follicular lymphoma, chronic lymphocytic leukemia (CLL)/small lymphocytic lymphoma (SLL), mantle cell lymphoma (MCL), marginal zone lymphoma, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, or primary effusion lymphoma.

1291. The MBM of embodiment 1290, wherein the non-Hodgkin's lymphoma is diffuse large B-cell lymphoma (DLBCL).

1292. The MBM of embodiment 1290, wherein the non-Hodgkin's lymphoma is follicular lymphoma.

1293. The MBM of embodiment 1290, wherein the non-Hodgkin's lymphoma is chronic lymphocytic leukemia (CLL)/small lymphocytic lymphoma (SLL).

1294. The MBM of embodiment 1290, wherein the non-Hodgkin's lymphoma is mantle cell lymphoma (MCL).

1295. The MBM of embodiment 1290, wherein the non-Hodgkin's lymphoma is marginal zone lymphoma.

1296. The MBM of embodiment 1290, wherein the non-Hodgkin's lymphoma is Burkitt lymphoma.

1297. The MBM of embodiment 1290, wherein the non-Hodgkin's lymphoma is lymphoplasmacytic lymphoma (Waldenstrom macroglobulinemia).

1298. The MBM of embodiment 1290, wherein the non-Hodgkin's lymphoma is hairy cell leukemia.

1299. The MBM of embodiment 1290, wherein the non-Hodgkin's lymphoma is primary central nervous system (CNS) lymphoma.

1300. The MBM of embodiment 1290, wherein the non-Hodgkin's lymphoma is primary mediastinal large B-cell lymphoma.

1301. The MBM of embodiment 1290, wherein the non-Hodgkin's lymphoma is mediastinal grey-zone lymphoma (MGZL).

1302. The MBM of embodiment 1290, wherein the non-Hodgkin's lymphoma is splenic marginal zone B-cell lymphoma.

1303. The MBM of embodiment 1290, wherein the non-Hodgkin's lymphoma is extranodal marginal zone B-cell lymphoma of MALT.

1304. The MBM of embodiment 1290, wherein the non-Hodgkin's lymphoma is nodal marginal zone B-cell lymphoma.

1305. The MBM of embodiment 1290, wherein the non-Hodgkin's lymphoma is primary effusion lymphoma.

1306. The MBM of embodiment 1287, wherein the non-Hodgkin's lymphoma is a T cell lymphoma.

1307. The MBM of embodiment 1306, wherein the non-Hodgkin's lymphoma is anaplastic large cell lymphoma (ALCL), adult T-cell lymphoma/leukemia, angiocentric lymphoma, angioimmunoblastic T-cell lymphoma, cutaneous T-cell lymphoma, extranodal natural killer/T-cell lymphoma, enteropathy type intestinal T-cell lymphoma, precursor T-lymphoblastic lymphoma/leukemia (T-LBL/L), or unspecified peripheral T-cell lymphoma.

1308. The MBM of embodiment 1307, wherein the non-Hodgkin's lymphoma is anaplastic large cell lymphoma (ALCL).

1309. The MBM of embodiment 1307, wherein the non-Hodgkin's lymphoma is adult T-cell lymphoma/leukemia.

1310. The MBM of embodiment 1307, wherein the non-Hodgkin's lymphoma is angiocentric lymphoma.

1311. The MBM of embodiment 1307, wherein the non-Hodgkin's lymphoma is angioimmunoblastic T-cell lymphoma.

1312. The MBM of embodiment 1307, wherein the non-Hodgkin's lymphoma is cutaneous T-cell lymphoma.

1313. The MBM of embodiment 1307, wherein the non-Hodgkin's lymphoma is extranodal natural killer/T-cell lymphoma.

1314. The MBM of embodiment 1307, wherein the non-Hodgkin's lymphoma is enteropathy type intestinal T-cell lymphoma.

1315. The MBM of embodiment 1307, wherein the non-Hodgkin's lymphoma is precursor T-lymphoblastic lymphoma/leukemia (T-LBL/L).

1316. The MBM of embodiment 1307, wherein the non-Hodgkin's lymphoma is unspecified peripheral T-cell lymphoma.

1317. The MBM of embodiment 1279, wherein the cancer is multiple myeloma. 1318. The MBM of embodiment 1279, wherein the cancer is a plasmacytic dendritic cell neoplasm.

1319. The MBM of embodiment 1279, wherein the cancer comprises a leukemia.

1320. The MBM of embodiment 1319, wherein the leukemia is B-cell acute lymphoid leukemia ("BALL"), T-cell acute lymphoid leukemia ("TALL"), acute lymphoid leukemia (ALL), chronic myelogenous leukemia (CML), chronic lymphocytic leukemia (CLL), B-cell chronic lymphocytic leukemia (B-CLL), B-cell prolymphocytic leukemia (B-PLL), hair cell leukemia, plasmacytoma/myeloma, precursor B-lymphoblastic leukemia/lymphoma (PB-LBL/L), large granular lymphocyte leukemia, precursor T-lymphoblastic lymphoma/leukemia (T-LBL/L), T-cell chronic lymphocytic leukemia/prolymphocytic leukemia (T-CLL/PLL).

1321. The MBM of embodiment 1320, wherein the leukemia is B-cell acute lymphoid leukemia ("BALL").

1322. The MBM of embodiment 1320, wherein the leukemia is T-cell acute lymphoid leukemia ("TALL").

1323. The MBM of embodiment 1320, wherein the leukemia is acute lymphoid leukemia (ALL).

1324. The MBM of embodiment 1320, wherein the leukemia is chronic myelogenous leukemia (CML).

1325. The MBM of embodiment 1320, wherein the leukemia is chronic lymphocytic leukemia (CLL).

1326. The MBM of embodiment 1320, wherein the leukemia is B-cell chronic lymphocytic leukemia (B-CLL).

1327. The MBM of embodiment 1320, wherein the leukemia is B-cell prolymphocytic leukemia (B-PLL).

1328. The MBM of embodiment 1320, wherein the leukemia is hair cell leukemia. 1329. The MBM of embodiment 1320, wherein the leukemia is plasmacytoma/myeloma.

1330. The MBM of embodiment 1320, wherein the leukemia is precursor B-lymphoblastic leukemia/lymphoma (PB-LBL/L).

1331. The MBM of embodiment 1320, wherein the leukemia is large granular lymphocyte leukemia.

1332. The MBM of embodiment 1320, wherein the leukemia is precursor T-lymphoblastic lymphoma/leukemia (T-LBL/L).

1333. The MBM of embodiment 1320, wherein the leukemia is T-cell chronic lymphocytic leukemia/prolymphocytic leukemia (T-CLL/PLL).

1334. The MBM of embodiment 1279, wherein the cancer is a brain cancer.

1335. The MBM of embodiment 1334, wherein the brain cancer is astrocytoma or glioblastoma.

1336. The MBM of embodiment 1335, wherein the brain cancer is astrocytoma.

1337. The MBM of embodiment 1335, wherein the brain cancer is glioblastoma.

1338. The MBM of embodiment 1279, wherein the cancer is prostate cancer.

1339. The MBM of embodiment 1338, wherein the prostate cancer is castrate-resistant prostate cancer.

1340. The MBM of embodiment 1338, wherein the prostate cancer is therapy-resistant prostate cancer.

1341. The MBM of embodiment 1338, wherein the prostate cancer is metastatic prostate cancer.

1342. The MBM of embodiment 1279, wherein the cancer is pancreatic cancer.

1343. The MBM of embodiment 1279, wherein the cancer is lung cancer.

1344. The MBM of embodiment 1278, wherein the disease or disorder comprises a plasma cell neoplasm.

1345. The MBM of embodiment 1344, wherein plasma cell neoplasm comprises smoldering multiple myeloma (SMM) or monoclonal gammopathy of undetermined significance (MGUS).

1346. The MBM of embodiment 1345, wherein the plasma cell neoplasm comprises smoldering multiple myeloma (SMM).

1347. The MBM of embodiment 1345, wherein the plasma cell neoplasm comprises monoclonal gammopathy of undetermined significance (MGUS).

1348. The MBM of embodiment 1278, wherein the disease or disorder comprises a plasmacytoma.

1349. The MBM of embodiment 1348, wherein the plasmacytoma is plasma cell dyscrasia, solitary myeloma, solitary plasmacytoma, extramedullary plasmacytoma, or multiple plasmacytoma.

1350. The MBM of embodiment 1348, wherein the plasmacytoma is plasma cell dyscrasia.

1351. The MBM of embodiment 1348, wherein the plasmacytoma is solitary myeloma.

1352. The MBM of embodiment 1348, wherein the plasmacytoma is solitary plasmacytoma.

1353. The MBM of embodiment 1348, wherein the plasmacytoma is extramedullary plasmacytoma.

1354. The MBM of embodiment 1348, wherein the plasmacytoma is multiple plasmacytoma.

1355. The MBM of embodiment 1278, wherein the disease or disorder comprises systemic amyloid light chain amyloidosis.

1356. The MBM of embodiment 1278, wherein the disease or disorder comprises POEMS syndrome.

1357. The MBM of embodiment 1278, wherein the disease or disorder is an infection.

1358. The MBM of embodiment 1357, wherein the infection is a viral infection.

1359. The MBM of embodiment 1358, wherein the viral infection is an HIV infection.

1360. The MBM of embodiment 1357, wherein the infection is a fungal infection.

1361. The MBM of embodiment 1360, wherein the fungal infection is a C. neoformans infection.

1362. The MBM of embodiment 1278, wherein the disease or disorder is an autoimmune disorder.

1363. The MBM of embodiment 1362, wherein the autoimmune disorder is selected from systemic lupus erythematosus (SLE), Sjögren's syndrome, scleroderma, rheumatoid arthritis (RA), juvenile idiopathic arthritis, graft versus host disease, dermatomyositis, type I diabetes mellitus, Hashimoto's thyroiditis, Graves's disease, Addison's disease, celiac disease, Crohn's Disease, pernicious anaemia, pemphigus vulgaris, vitiligo, autoimmune haemolytic anaemia, idiopathic thrombocytopenic purpura, giant cell arteritis, myasthenia gravis, multiple sclerosis (MS) (e.g., relapsing-remitting MS (RRMS)), glomerulonephritis, Goodpasture's syndrome, bullous pemphigoid, colitis ulcerosa, Guillain-Barré syndrome, chronic inflammatory demyelinating polyneuropathy, anti-phospholipid syndrome, narcolepsy, sarcoidosis, and Wegener's granulomatosis.

1364. The MBM of embodiment 1362, wherein the autoimmune disorder is systemic lupus erythematosus (SLE).

1365. The MBM of embodiment 1362, wherein the autoimmune disorder is Sjögren's syndrome.

1366. The MBM of embodiment 1362, wherein the autoimmune disorder is scleroderma.

1367. The MBM of embodiment 1362, wherein the autoimmune disorder is rheumatoid arthritis (RA).

1368. The MBM of embodiment 1362, wherein the autoimmune disorder is juvenile idiopathic arthritis.

1369. The MBM of embodiment 1362, wherein the autoimmune disorder is graft versus host disease.

1370. The MBM of embodiment 1362, wherein the autoimmune disorder is dermatomyositis.

1371. The MBM of embodiment 1362, wherein the autoimmune disorder is type I diabetes mellitus.

1372. The MBM of embodiment 1362, wherein the autoimmune disorder is Hashimoto's thyroiditis.

1373. The MBM of embodiment 1362, wherein the autoimmune disorder is Graves's disease.

1374. The MBM of embodiment 1362, wherein the autoimmune disorder is Addison's disease.

1375. The MBM of embodiment 1362, wherein the autoimmune disorder is celiac disease.

1376. The MBM of embodiment 1362, wherein the autoimmune disorder is Crohn's Disease.

1377. The MBM of embodiment 1362, wherein the autoimmune disorder is pernicious anaemia.

1378. The MBM of embodiment 1362, wherein the autoimmune disorder is pemphigus vulgaris.

1379. The MBM of embodiment 1362, wherein the autoimmune disorder is vitiligo.

1380. The MBM of embodiment 1362, wherein the autoimmune disorder is autoimmune haemolytic anaemia.

1381. The MBM of embodiment 1362, wherein the autoimmune disorder is idiopathic thrombocytopenic purpura.

1382. The MBM of embodiment 1362, wherein the autoimmune disorder is giant cell arteritis.

1383. The MBM of embodiment 1362, wherein the autoimmune disorder is myasthenia gravis.

1384. The MBM of embodiment 1362, wherein the autoimmune disorder is multiple sclerosis (MS).

1385. The MBM of embodiment 1362, wherein the MS is relapsing-remitting MS (RRMS).

1386. The MBM of embodiment 1362, wherein the autoimmune disorder is glomerulonephritis.

1387. The MBM of embodiment 1362, wherein the autoimmune disorder is Goodpasture's syndrome.

1388. The MBM of embodiment 1362, wherein the autoimmune disorder is bullous pemphigoid.

1389. The MBM of embodiment 1362, wherein the autoimmune disorder is colitis ulcerosa.

1390. The MBM of embodiment 1362, wherein the autoimmune disorder is Guillain-Barré syndrome.

1391. The MBM of embodiment 1362, wherein the autoimmune disorder is chronic inflammatory demyelinating polyneuropathy.

1392. The MBM of embodiment 1362, wherein the autoimmune disorder is anti-phospholipid syndrome.

1393. The MBM of embodiment 1362, wherein the autoimmune disorder is narcolepsy.

1394. The MBM of embodiment 1362, wherein the autoimmune disorder is sarcoidosis.

1395. The MBM of embodiment 1362, wherein the autoimmune disorder is Wegener's granulomatosis.

1396. A conjugate comprising the MBM of any one of embodiments 1 to 1276, and an agent, optionally a therapeutic agent, a diagnostic agent, a masking moiety, a cleavable moiety, or any combination thereof.

1397. The conjugate of embodiment 1396, wherein the agent is a cytotoxic or cytostatic agent.

1398. The conjugate of embodiment 1397, wherein the agent is any one of the agents described in Section 7.10.

1399. The conjugate of embodiment 1397 or 1398, wherein the agent is any one of the agents described in Section 7.10.1.

1400. The conjugate of any one of embodiments 1396 to 1399, wherein the MBM is conjugated to a radionuclide.

1401. The conjugate of any one of embodiments 1396 to 1399, wherein the MBM is conjugated to an alkylating agent.

1402. The conjugate of any one of embodiments 1396 to 1399, wherein the MBM is conjugated to a topoisomerase inhibitor, which is optionally a topoisomerase I inhibitor or a topoisomerase II inhibitor.

1403. The conjugate of any one of embodiments 1396 to 1399, wherein the MBM is conjugated to a DNA damaging agent.

1404. The conjugate of any one of embodiments 1396 to 1399, wherein the MBM is conjugated to a DNA intercalating agent, optionally a groove binding agent such as a minor groove binding agent.

1405. The conjugate of any one of embodiments 1396 to 1399, wherein the MBM is conjugated to a RNA/DNA antimetabolite.

1406. The conjugate of any one of embodiments 1396 to 1399, wherein the MBM is conjugated to a kinase inhibitor.

1407. The conjugate of any one of embodiments 1396 to 1399, wherein the MBM is conjugated to a protein synthesis inhibitor.

1408. The conjugate of any one of embodiments 1396 to 1399, wherein the MBM is conjugated to a histone deacetylase (HDAC) inhibitor.

1409. The conjugate of any one of embodiments 1396 to 1399, wherein the MBM is conjugated to a mitochondrial inhibitor, which is optionally an inhibitor of a phosphoryl transfer reaction in mitochondria.

1410. The conjugate of any one of embodiments 1396 to 1399, wherein the MBM is conjugated to an antimitotic agent.

1411. The conjugate of any one of embodiments 1396 to 1399, wherein the MBM is conjugated to a maytansinoid.

1412. The conjugate of any one of embodiments 1396 to 1399, wherein the MBM is conjugated to a kinesin inhibitor.

1413. The conjugate of any one of embodiments 1396 to 1399, wherein the MBM is conjugated to a kinesin-like protein KIF11 inhibitor.

1414. The conjugate of any one of embodiments 1396 to 1399, wherein the MBM is conjugated to a V-ATPase (vacuolar-type H+-ATPase) inhibitor.

1415. The conjugate of any one of embodiments 1396 to 1399, wherein the MBM is conjugated to a pro-apoptotic agent.

1416. The conjugate of any one of embodiments 1396 to 1399, wherein the MBM is conjugated to a Bcl2 (B-cell lymphoma 2) inhibitor.

1417. The conjugate of any one of embodiments 1396 to 1399, wherein the MBM is conjugated to an MCL1 (myeloid cell leukemia 1) inhibitor.

1418. The conjugate of any one of embodiments 1396 to 1399, wherein the MBM is conjugated to a HSP90 (heat shock protein 90) inhibitor.

1419. The conjugate of any one of embodiments 1396 to 1399, wherein the MBM is conjugated to an IAP (inhibitor of apoptosis) inhibitor.

1420. The conjugate of any one of embodiments 1396 to 1399, wherein the MBM is conjugated to an mTOR (mechanistic target of rapamycin) inhibitor.

1421. The conjugate of any one of embodiments 1396 to 1399, wherein the MBM is conjugated to a microtubule stabilizer.

1422. The conjugate of any one of embodiments 1396 to 1399, wherein the MBM is conjugated to a microtubule destabilizer.

1423. The conjugate of any one of embodiments 1396 to 1399, wherein the MBM is conjugated to an auristatin.

1424. The conjugate of any one of embodiments 1396 to 1399, wherein the MBM is conjugated to a dolastatin.

1425. The conjugate of any one of embodiments 1396 to 1399, wherein the MBM is conjugated to a MetAP (methionine aminopeptidase).

1426. The conjugate of any one of embodiments 1396 to 1399, wherein the MBM is conjugated to a CRM1 (chromosomal maintenance 1) inhibitor.

1427. The conjugate of any one of embodiments 1396 to 1399, wherein the MBM is conjugated to a DPPIV (dipeptidyl peptidase IV) inhibitor.

1428. The conjugate of any one of embodiments 1396 to 1399, wherein the MBM is conjugated to a proteasome inhibitor.

1429. The conjugate of any one of embodiments 1396 to 1399, wherein the MBM is conjugated to a protein synthesis inhibitor.

1430. The conjugate of any one of embodiments 1396 to 1399, wherein the MBM is conjugated to a CDK2 (cyclin-dependent kinase 2) inhibitor.

1431. The conjugate of any one of embodiments 1396 to 1399, wherein the MBM is conjugated to a CDK9 (cyclin-dependent kinase 9) inhibitor.

1432. The conjugate of any one of embodiments 1396 to 1399, wherein the MBM is conjugated to a RNA polymerase inhibitor.

1433. The conjugate of any one of embodiments 1396 to 1399, wherein the MBM is conjugated to a DHFR (dihydrofolate reductase) inhibitor.

1434. The conjugate of any one of embodiments 1396 to 1433, wherein the agent is attached to the MBM with a linker, which is optionally a cleavable linker or a non-cleavable linker, e.g., a linker as described in Section 7.10.2.

1435. The conjugate of any one of embodiments 1396 to 1434, wherein the cytotoxic or cytostatic agent is conjugated to the MBM via a linker as described in Section 7.10.2.

1436. A preparation of MBMs comprising a plurality of MBMs molecules according to any one of embodiments 1 to 1395 or a plurality of conjugate molecules according to any one of embodiments 1396 to 1435, optionally wherein the plurality comprises at least 100, at least 1,000, at least 10,000, or at least 100,000 MBM molecules or conjugate molecules.

1437. The preparation of embodiment 1436, wherein at least 50% of the MBM molecules in the preparation have the same primary amino acid sequence.

1438. The preparation of embodiment 1436, wherein at least 60% of the MBM molecules in the preparation have the same primary amino acid sequence.

1439. The preparation of embodiment 1436, wherein at least 70% of the MBM molecules in the preparation have the same primary amino acid sequence.

1440. The preparation of embodiment 1436, wherein at least 80% of the MBM molecules in the preparation have the same primary amino acid sequence.

1441. The preparation of embodiment 1436, wherein at least 90% of the MBM molecules in the preparation have the same primary amino acid sequence.

1442. The preparation of embodiment 1436, wherein at least 95% of the MBM molecules in the preparation have the same primary amino acid sequence.

1443. The preparation of embodiment 1436, wherein at least 97% of the MBM molecules in the preparation have the same primary amino acid sequence.

1444. The preparation of embodiment 1436, wherein at least 98% of the MBM molecules in the preparation have the same primary amino acid sequence.

1445. The preparation of embodiment 1436, wherein at least 99% of the MBM molecules in the preparation have the same primary amino acid sequence.

1446. The preparation of embodiment 1436, wherein 50% to 95% of the MBM molecules in the preparation have the same primary amino acid sequence.

1447. The preparation of embodiment 1436, wherein 50% to 80% of the MBM molecules in the preparation have the same primary amino acid sequence.

1448. The preparation of embodiment 1436, wherein 50% to 70% of the MBM molecules in the preparation have the same primary amino acid sequence.

1449. The preparation of embodiment 1436, wherein 60% to 95% of the MBM molecules in the preparation have the same primary amino acid sequence.

1450. The preparation of embodiment 1436, wherein 60% to 80% of the MBM molecules in the preparation have the same primary amino acid sequence.

1451. The preparation of embodiment 1436, wherein 60% to 70% of the MBM molecules in the preparation have the same primary amino acid sequence.

1452. The preparation of embodiment 1436, wherein 70% to 95% of the MBM molecules in the preparation have the same primary amino acid sequence.

1453. The preparation of embodiment 1436, wherein 70% to 80% of the MBM molecules in the preparation have the same primary amino acid sequence.

1454. The preparation of embodiment 1436, wherein 80% to 95% of the MBM molecules in the preparation have the same primary amino acid sequence.

1455. The preparation of embodiment 1436, wherein 95% to 99% of the MBM molecules in the preparation have the same primary amino acid sequence.

1456. The preparation of any one of embodiments 1436 to 1455, wherein at least 50% of the MBM molecules in the preparation have the same interchain crosslinks.

1457. The preparation of any one of embodiments 1436 to 1455, wherein at least 60% of the MBM molecules in the preparation have the same interchain crosslinks.

1458. The preparation of any one of embodiments 1436 to 1455, wherein at least 70% of the MBM molecules in the preparation have the same interchain crosslinks.

1459. The preparation of any one of embodiments 1436 to 1455, wherein at least 80% of the MBM molecules in the preparation have the same interchain crosslinks.

1460. The preparation of any one of embodiments 1436 to 1455, wherein at least 90% of the MBM molecules in the preparation have the same interchain crosslinks.

1461. The preparation of any one of embodiments 1436 to 1455, wherein at least 95% of the MBM molecules in the preparation have the same interchain crosslinks.

1462. The preparation of any one of embodiments 1436 to 1455, wherein at least 97% of the MBM molecules in the preparation have the same interchain crosslinks.

1463. The preparation of any one of embodiments 1436 to 1455, wherein at least 98% of the MBM molecules in the preparation have the same interchain crosslinks.

1464. The preparation of any one of embodiments 1436 to 1455, wherein at least 99% of the MBM molecules in the preparation have the same interchain crosslinks.

1465. The preparation of any one of embodiments 1436 to 1455, wherein 50% to 95% of the MBM molecules in the preparation have the same interchain crosslinks.

1466. The preparation of any one of embodiments 1436 to 1455, wherein 50% to 80% of the MBM molecules in the preparation have the same interchain crosslinks.

1467. The preparation of any one of embodiments 1436 to 1455, wherein 50% to 70% of the MBM molecules in the preparation have the same interchain crosslinks.

1468. The preparation of any one of embodiments 1436 to 1455, wherein 60% to 95% of the MBM molecules in the preparation have the same interchain crosslinks.

1469. The preparation of any one of embodiments 1436 to 1455, wherein 60% to 80% of the MBM molecules in the preparation have the same interchain crosslinks.

1470. The preparation of any one of embodiments 1436 to 1455, wherein 60% to 70% of the MBM molecules in the preparation have the same interchain crosslinks.

1471. The preparation of any one of embodiments 1436 to 1455, wherein 70% to 95% of the MBM molecules in the preparation have the same interchain crosslinks.

1472. The preparation of any one of embodiments 1436 to 1455, wherein 70% to 80% of the MBM molecules in the preparation have the same interchain crosslinks.

1473. The preparation of any one of embodiments 1436 to 1455, wherein 80% to 95% of the MBM molecules in the preparation have the same interchain crosslinks.

1474. The preparation of any one of embodiments 1436 to 1455, wherein 95% to 99% of the MBM molecules in the preparation have the same interchain crosslinks.

1475. The preparation of any one of embodiments 1436 to 1474, wherein at least 50% of the MBM molecules in the preparation have the same ABM1:ABM2:ABM3 ratio.

1476. The preparation of any one of embodiments 1436 to 1474, wherein at least 60% of the MBM molecules in the preparation have the same ABM1:ABM2:ABM3 ratio.

1477. The preparation of any one of embodiments 1436 to 1474, wherein at least 70% of the MBM molecules in the preparation have the same ABM1:ABM2:ABM3 ratio.

1478. The preparation of any one of embodiments 1436 to 1474, wherein at least 80% of the MBM molecules in the preparation have the same ABM1:ABM2:ABM3 ratio.

1479. The preparation of any one of embodiments 1436 to 1474, wherein at least 90% of the MBM molecules in the preparation have the same ABM1:ABM2:ABM3 ratio.

1480. The preparation of any one of embodiments 1436 to 1474, wherein at least 95% of the MBM molecules in the preparation have the same ABM1:ABM2:ABM3 ratio.

1481. The preparation of any one of embodiments 1436 to 1474, wherein at least 97% of the MBM molecules in the preparation have the same ABM1:ABM2:ABM3 ratio.

1482. The preparation of any one of embodiments 1436 to 1474, wherein at least 98% of the MBM molecules in the preparation have the same ABM1:ABM2:ABM3 ratio.

1483. The preparation of any one of embodiments 1436 to 1474, wherein at least 99% of the MBM molecules in the preparation have the same ABM1:ABM2:ABM3 ratio.

1484. The preparation of any one of embodiments 1436 to 1474, wherein 50% to 95% of the MBM molecules in the preparation have the same ABM1:ABM2:ABM3 ratio.

1485. The preparation of any one of embodiments 1436 to 1474, wherein 50% to 80% of the MBM molecules in the preparation have the same ABM1:ABM2:ABM3 ratio.

1486. The preparation of any one of embodiments 1436 to 1474, wherein 50% to 70% of the MBM molecules in the preparation have the same ABM1:ABM2:ABM3 ratio.

1487. The preparation of any one of embodiments 1436 to 1474, wherein 60% to 95% of the MBM molecules in the preparation have the same ABM1:ABM2:ABM3 ratio.

1488. The preparation of any one of embodiments 1436 to 1474, wherein 60% to 80% of the MBM molecules in the preparation have the same ABM1:ABM2:ABM3 ratio.

1489. The preparation of any one of embodiments 1436 to 1474, wherein 60% to 70% of the MBM molecules in the preparation have the same ABM1:ABM2:ABM3 ratio.

1490. The preparation of any one of embodiments 1436 to 1474, wherein 70% to 95% of the MBM molecules in the preparation have the same ABM1:ABM2:ABM3 ratio.

1491. The preparation of any one of embodiments 1436 to 1474, wherein 70% to 80% of the MBM molecules in the preparation have the same ABM1:ABM2:ABM3 ratio.

1492. The preparation of any one of embodiments 1436 to 1474, wherein 80% to 95% of the MBM molecules in the preparation have the same ABM1:ABM2:ABM3 ratio.

1493. The preparation of any one of embodiments 1436 to 1474, wherein 95% to 99% of the MBM molecules in the preparation have the same ABM1:ABM2:ABM3 ratio.

1494. A pharmaceutical composition comprising the MBM of any one of embodiments 1 to 1276, the conjugate of any one of embodiments 1396 to 1435, or the preparation of any one of embodiments 1436 to 1493, and an excipient.

1495. A method of treating a subject having a disease or disorder associated with expression of BCMA, comprising administering to a subject an effective amount of the MBM of any one of embodiments 1 to 1395, the conjugate of any one of embodiments 1396 to 1435, the preparation of any one of embodiments 1436 to 1493, or the pharmaceutical composition of embodiment 1494.

1496. The method of embodiment 1495, wherein the disease or disorder comprises a cancer.

1497. The method of embodiment 1496, wherein the cancer comprises a B cell malignancy.

1498. The method of embodiment 1497, wherein when the MBM is a MBM that binds specifically to a TAA, the B cell malignancy comprises cancerous B cells expressing both BCMA and the TAA.

1499. The method of embodiment 1497, wherein when the MBM is a MBM that binds specifically to a TAA, the B cell malignancy comprises cancerous B cells expressing BCMA, but not the TAA, and cancerous B cells expressing the TAA, but not BCMA.

1500. The method of any one of embodiments 1497 to 1499, wherein the B cell malignancy is selected from selected from Hodgkin's lymphoma, non-Hodgkin's lymphoma and multiple myeloma.

1501. The method of embodiment 1496, wherein the cancer is Hodgkin's lymphoma.

1502. The method of embodiment 1501, wherein the Hodgkin's lymphoma is nodular sclerosing Hodgkin's lymphoma.

1503. The method of embodiment 1501, wherein the Hodgkin's lymphoma is mixed-cellularity subtype Hodgkin's lymphoma.

1504. The method of embodiment 1501, wherein the Hodgkin's lymphoma is lymphocyte-rich or lymphocytic predominance Hodgkin's lymphoma.

1505. The method of embodiment 1501, wherein the Hodgkin's lymphoma is lymphocyte depleted Hodgkin's lymphoma.

1506. The method of embodiment 1496, wherein the cancer is non-Hodgkin's lymphoma.

1507. The method of embodiment 1506, wherein the non-Hodgkin's lymphoma is a B cell lymphoma or a T cell lymphoma.

1508. The method of embodiment 1507, wherein the non-Hodgkin's lymphoma is a B cell lymphoma.

1509. The method of embodiment 1508, wherein the non-Hodgkin's lymphoma is diffuse large B-cell lymphoma (DLBCL), follicular lymphoma, chronic lymphocytic leukemia (CLL)/small lymphocytic lymphoma (SLL), mantle cell lymphoma (MCL), marginal zone lymphoma, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, or primary effusion lymphoma.

1510. The method of embodiment 1509, wherein the non-Hodgkin's lymphoma is diffuse large B-cell lymphoma (DLBCL).

1511. The method of embodiment 1509, wherein the non-Hodgkin's lymphoma is follicular lymphoma.

1512. The method of embodiment 1509, wherein the non-Hodgkin's lymphoma is chronic lymphocytic leukemia (CLL)/small lymphocytic lymphoma (SLL).

1513. The method of embodiment 1509, wherein the non-Hodgkin's lymphoma is mantle cell lymphoma (MCL).

1514. The method of embodiment 1509, wherein the non-Hodgkin's lymphoma is marginal zone lymphoma.

1515. The method of embodiment 1509, wherein the non-Hodgkin's lymphoma is Burkitt lymphoma.

1516. The method of embodiment 1509, wherein the non-Hodgkin's lymphoma is lymphoplasmacytic lymphoma (Waldenstrom macroglobulinemia).

1517. The method of embodiment 1509, wherein the non-Hodgkin's lymphoma is hairy cell leukemia.

1518. The method of embodiment 1509, wherein the non-Hodgkin's lymphoma is primary central nervous system (CNS) lymphoma.

1519. The method of embodiment 1509, wherein the non-Hodgkin's lymphoma is primary mediastinal large B-cell lymphoma.

1520. The method of embodiment 1509, wherein the non-Hodgkin's lymphoma is mediastinal grey-zone lymphoma (MGZL).

1521. The method of embodiment 1509, wherein the non-Hodgkin's lymphoma is splenic marginal zone B-cell lymphoma.

1522. The method of embodiment 1509, wherein the non-Hodgkin's lymphoma is extranodal marginal zone B-cell lymphoma of MALT.

1523. The method of embodiment 1509, wherein the non-Hodgkin's lymphoma is nodal marginal zone B-cell lymphoma.

1524. The method of embodiment 1509, wherein the non-Hodgkin's lymphoma is primary effusion lymphoma.

1525. The method of embodiment 1507, wherein the non-Hodgkin's lymphoma is a T cell lymphoma.

1526. The method of embodiment 1525, wherein the non-Hodgkin's lymphoma is anaplastic large cell lymphoma (ALCL), adult T-cell lymphoma/leukemia, angiocentric lymphoma, angioimmunoblastic T-cell lymphoma, cutaneous T-cell lymphoma, extranodal natural killer/T-cell lymphoma, enteropathy type intestinal T-cell lymphoma, precursor T-lymphoblastic lymphoma/leukemia (T-LBL/L), or unspecified peripheral T-cell lymphoma.

1527. The method of embodiment 1526, wherein the non-Hodgkin's lymphoma is anaplastic large cell lymphoma (ALCL).

1528. The method of embodiment 1526, wherein the non-Hodgkin's lymphoma is adult T-cell lymphoma/leukemia.

1529. The method of embodiment 1526, wherein the non-Hodgkin's lymphoma is angiocentric lymphoma.

1530. The method of embodiment 1526, wherein the non-Hodgkin's lymphoma is angioimmunoblastic T-cell lymphoma.

1531. The method of embodiment 1526, wherein the non-Hodgkin's lymphoma is cutaneous T-cell lymphoma.

1532. The method of embodiment 1526, wherein the non-Hodgkin's lymphoma is extranodal natural killer/T-cell lymphoma.

1533. The method of embodiment 1526, wherein the non-Hodgkin's lymphoma is enteropathy type intestinal T-cell lymphoma.

1534. The method of embodiment 1526, wherein the non-Hodgkin's lymphoma is precursor T-lymphoblastic lymphoma/leukemia (T-LBL/L).

1535. The method of embodiment 1526, wherein the non-Hodgkin's lymphoma is unspecified peripheral T-cell lymphoma.

1536. The method of embodiment 1496, wherein the cancer is multiple myeloma.

1537. The method of embodiment 1496, wherein the cancer is a plasmacytic dendritic cell neoplasm.

1538. The method of embodiment 1496, wherein the cancer comprises a leukemia.

1539. The method of embodiment 1538, wherein the leukemia is B-cell acute lymphoid leukemia ("BALL"), T-cell acute lymphoid leukemia ("TALL"), acute lymphoid leukemia (ALL), chronic myelogenous leukemia (CML), chronic lymphocytic leukemia (CLL), B-cell chronic lymphocytic leukemia (B-CLL), B-cell prolymphocytic leukemia (B-PLL), hair cell leukemia, plasmacytoma/myeloma, precursor B-lymphoblastic leukemia/lymphoma (PB-LBL/L), large granular lymphocyte leukemia, precursor T-lymphoblastic lymphoma/leukemia (T-LBL/L), T-cell chronic lymphocytic leukemia/prolymphocytic leukemia (T-CLL/PLL).

1540. The method of embodiment 1538, wherein the leukemia is B-cell acute lymphoid leukemia ("BALL").

1541. The method of embodiment 1538, wherein the leukemia is T-cell acute lymphoid leukemia ("TALL").

1542. The method of embodiment 1538, wherein the leukemia is acute lymphoid leukemia (ALL).

1543. The method of embodiment 1538, wherein the leukemia is chronic myelogenous leukemia (CML).

1544. The method of embodiment 1538, wherein the leukemia is chronic lymphocytic leukemia (CLL).

1545. The method of embodiment 1538, wherein the leukemia is B-cell chronic lymphocytic leukemia (B-CLL).

1546. The method of embodiment 1538, wherein the leukemia is B-cell prolymphocytic leukemia (B-PLL).

1547. The method of embodiment 1538, wherein the leukemia is hair cell leukemia. 1548. The method of embodiment 1538, wherein the leukemia is plasmacytoma/myeloma.

1549. The method of embodiment 1538, wherein the leukemia is precursor B-lymphoblastic leukemia/lymphoma (PB-LBL/L).

1550. The method of embodiment 1538, wherein the leukemia is large granular lymphocyte leukemia.

1551. The method of embodiment 1538, wherein the leukemia is precursor T-lymphoblastic lymphoma/leukemia (T-LBL/L).

1552. The method of embodiment 1538, wherein the leukemia is T-cell chronic lymphocytic leukemia/prolymphocytic leukemia (T-CLL/PLL).

1553. The method of embodiment 1496, wherein the cancer is a brain cancer. 1554. The method of embodiment 1553, wherein the brain cancer is astrocytoma or glioblastoma.

1555. The method of embodiment 1554, wherein the brain cancer is astrocytoma.

1556. The method of embodiment 1554, wherein the brain cancer is glioblastoma.

1557. The method of embodiment 1496, wherein the cancer is prostate cancer.

1558. The method of embodiment 1557, wherein the prostate cancer is castrate-resistant prostate cancer.

1559. The method of embodiment 1557, wherein the prostate cancer is therapy-resistant prostate cancer.

1560. The method of embodiment 1557, wherein the prostate cancer is metastatic prostate cancer.

1561. The method of embodiment 1496, wherein the cancer is pancreatic cancer.

1562. The method of embodiment 1496, wherein the cancer is lung cancer.

1563. The method of embodiment 1496, wherein the disease or disorder comprises a plasma cell neoplasm.

1564. The method of embodiment 1563, wherein plasma cell neoplasm comprises smoldering multiple myeloma (SMM) or monoclonal gammopathy of undetermined significance (MGUS).

1565. The method of embodiment 1564, wherein the plasma cell neoplasm comprises smoldering multiple myeloma (SMM).

1566. The method of embodiment 1564, wherein the plasma cell neoplasm comprises monoclonal gammopathy of undetermined significance (MGUS).

1567. The method of embodiment 1495, wherein the disease or disorder comprises a plasmacytoma.

1568. The method of embodiment 1567, wherein the plasmacytoma is plasma cell dyscrasia, solitary myeloma, solitary plasmacytoma, extramedullary plasmacytoma, or multiple plasmacytoma.

1569. The method of embodiment 1567, wherein the plasmacytoma is plasma cell dyscrasia.

1570. The method of embodiment 1567, wherein the plasmacytoma is solitary myeloma.

1571. The method of embodiment 1567, wherein the plasmacytoma is solitary plasmacytoma.

1572. The method of embodiment 1567, wherein the plasmacytoma is extramedullary plasmacytoma.

1573. The method of embodiment 1567, wherein the plasmacytoma is multiple plasmacytoma.

1574. The method of embodiment 1495, wherein the disease or disorder comprises systemic amyloid light chain amyloidosis.

1575. The method of embodiment 1495, wherein the disease or disorder comprises POEMS syndrome.

1576. The method of any one of embodiments 1495 to 1537, further comprising administering at least one additional agent to the subject.

1577. The method of embodiment 1576, wherein the additional agent is a chemotherapeutic agent.

1578. The method of embodiment 1576 or embodiment 1577, wherein the additional agent is an anthracycline.

1579. The method of embodiment 1576 or embodiment 1577, wherein the additional agent is a vinca alkaloid.

1580. The method of embodiment 1576 or embodiment 1577, wherein the additional agent is an alkylating agent.

1581. The method of embodiment 1576 or embodiment 1577, wherein the additional agent is an immune cell antibody.

1582. The method of embodiment 1576 or embodiment 1577, wherein the additional agent is an antimetabolite.

1583. The method of embodiment 1576 or embodiment 1577, wherein the additional agent is an adenosine deaminase inhibitor 1584. The method of embodiment 1576 or embodiment 1577, wherein the additional agent is an mTOR inhibitor.

1585. The method of embodiment 1576 or embodiment 1577, wherein the additional agent is a TNFR glucocorticoid induced TNFR related protein (GITR) agonist.

1586. The method of embodiment 1576 or embodiment 1577, wherein the additional agent is a proteasome inhibitor.

1587. The method of embodiment 1576 or embodiment 1577, wherein the additional agent is a BH3 mimetic.

1588. The method of embodiment 1576 or embodiment 1577, wherein the additional agent is a cytokine.

1589. The method of embodiment 1576 or embodiment 1577, wherein the additional agent prevents or slows shedding of BCMA from a cancer cell and/or, when the MBM binds specifically to a TAA, the TAA from a cancer cell.

1590. The method of embodiment 1589, wherein the additional agent comprises an ADAM10 inhibitor and/or an ADAM 17 inhibitor.

1591. The method of embodiment 1589, wherein the additional agent comprises a phospholipase inhibitor.

1592. The method of embodiment 1576 or embodiment 1577, wherein the additional agent is a gamma secretase inhibitor.

1593. The method of embodiment 1576 or embodiment 1577, wherein the additional agent is an immunomodulatory.

1594. The method of embodiment 1576 or embodiment 1577, wherein the additional agent is a thalidomide derivative.

1595. The method of embodiment 1576 or embodiment 1577, wherein the additional agent is an EGFR inhibitor.

1596. The method of embodiment 1576 or embodiment 1577, wherein the additional agent is an adenosine A2A receptor antagonist.

1597. The method of embodiment 1576 or embodiment 1577, wherein the additional agent is a CD20 inhibitor.

1598. The method of embodiment 1576 or embodiment 1577, wherein the additional agent is a CD22 inhibitor.

1599. The method of embodiment 1576 or embodiment 1577, wherein the additional agent is a FCRL2 inhibitor.

1600. The method of embodiment 1576 or embodiment 1577, wherein the additional agent is a FCRL5 inhibitor.

1601. The method of embodiment 1576 or embodiment 1577, wherein the additional agent is a IL-15/IL15-Ra complex.

1602. The method of embodiment 1576 or embodiment 1577, wherein the additional agent is a PD-1 inhibitor.

1603. The method of embodiment 1576 or embodiment 1577, wherein the additional agent is a PD-L1 inhibitor.

1604. The method of embodiment 1576 or embodiment 1577, wherein the additional agent is a LAG-3 inhibitor.

1605. The method of embodiment 1576 or embodiment 1577, wherein the additional agent is a TIM-3 inhibitor.

1606. The method of embodiment 1576 or embodiment 1577, wherein the additional agent is a TGF-13 inhibitor.

1607. The method of embodiment 1576 or embodiment 1577, wherein the additional agent is a CD73 inhibitor.

1608. The method of embodiment 1576 or embodiment 1577, wherein the additional agent is a IL-17 inhibitor.

1609. The method of embodiment 1576 or embodiment 1577, wherein the additional agent is a CD32B inhibitor 1610. The method of embodiment 1576 or embodiment 1577, wherein the additional agent is an agent selected from those listed in Table 18.

1611. The method of embodiment 1576, wherein the additional agent is an agent that reduces or ameliorates a side effect associated with the administration of a MBM that binds CD3.

1612. The method of embodiment 1611, wherein the additional agent comprises a steroid (e.g., corticosteroid), an inhibitor of TNFα (e.g., an anti-TNFα antibody molecule such as infliximab, adalimumab, certolizumab pegol, or golimumab, a fusion protein such as entanercept, a small molecule inhibitor of TNFα such as a xanthine derivative (e.g. pentoxifylline) or bupropion), an IL-6 inhibitor (e.g., an IL-6 antibody molecule such as tocilizumab (toc), sarilumab, elsilimomab, ONTO 328, ALD518/BMS-945429, ONTO 136, CPSI-2364, CDP6038, VX30, ARGX-109, FE301, or FM101), an IL-1R based inhibitor such as anakinra, a corticosteroid (e.g., methylprednisolone or hydrocortisone) in combination with Benadryl and Tylenol, a vasopressor (e.g., norepinephrine, dopamine, phenylephrine, epinephrine, vasopressin, or any combination thereof), an antipyretic agent, or an analgesic agent.

1613. The method of any one of embodiments 1576 to 1612, wherein the additional agent is not an antibody.

1614. The method of embodiment 1495, wherein the disease or disorder is an infection.

1615. The method of embodiment 1614, wherein the infection is a viral infection.

1616. The method of embodiment 1615, wherein the viral infection is an HIV infection.

1617. The method of embodiment 1614, wherein the infection is a fungal infection.

1618. The method of embodiment 1617, wherein the fungal infection is a C. neoformans infection.

1619. The method of embodiment 1495, wherein the disease or disorder is an autoimmune disorder.

1620. The method of embodiment 1619, wherein the autoimmune disorder is selected from systemic lupus erythematosus (SLE), Sjögren's syndrome, scleroderma, rheumatoid arthritis (RA), juvenile idiopathic arthritis, graft versus host disease, dermatomyositis, type I diabetes mellitus, Hashimoto's thyroiditis, Graves's disease, Addison's disease, celiac disease, Crohn's Disease, pernicious anaemia, pemphigus vulgaris, vitiligo, autoimmune haemolytic anaemia, idiopathic thrombocytopenic purpura, giant cell arteritis, myasthenia gravis, multiple sclerosis (MS) (e.g., relapsing-remitting MS (RRMS)), glomerulonephritis, Goodpasture's syndrome, bullous pemphigoid, colitis ulcerosa, Guillain-Barré syndrome, chronic inflammatory demyelinating polyneuropathy, anti-phospholipid syndrome, narcolepsy, sarcoidosis, and Wegener's granulomatosis.

1621. The method of embodiment 1620, wherein the autoimmune disorder is systemic lupus erythematosus (SLE).

1622. The method of embodiment 1620, wherein the autoimmune disorder is Sjögren's syndrome.

1623. The method of embodiment 1620, wherein the autoimmune disorder is scleroderma.

1624. The method of embodiment 1620, wherein the autoimmune disorder is rheumatoid arthritis (RA).

1625. The method of embodiment 1620, wherein the autoimmune disorder is juvenile idiopathic arthritis.

1626. The method of embodiment 1620, wherein the autoimmune disorder is graft versus host disease.

1627. The method of embodiment 1620, wherein the autoimmune disorder is dermatomyositis.

1628. The method of embodiment 1620, wherein the autoimmune disorder is type I diabetes mellitus.

1629. The method of embodiment 1620, wherein the autoimmune disorder is Hashimoto's thyroiditis.

1630. The method of embodiment 1620, wherein the autoimmune disorder is Graves's disease.

1631. The method of embodiment 1620, wherein the autoimmune disorder is Addison's disease.

1632. The method of embodiment 1620, wherein the autoimmune disorder is celiac disease.

1633. The method of embodiment 1620, wherein the autoimmune disorder is Crohn's Disease.

1634. The method of embodiment 1620, wherein the autoimmune disorder is pernicious anaemia.

1635. The method of embodiment 1620, wherein the autoimmune disorder is pemphigus vulgaris.

1636. The method of embodiment 1620, wherein the autoimmune disorder is vitiligo.

1637. The method of embodiment 1620, wherein the autoimmune disorder is autoimmune haemolytic anaemia.

1638. The method of embodiment 1620, wherein the autoimmune disorder is idiopathic thrombocytopenic purpura.

1639. The method of embodiment 1620, wherein the autoimmune disorder is giant cell arteritis.

1640. The method of embodiment 1620, wherein the autoimmune disorder is myasthenia gravis.

1641. The method of embodiment 1620, wherein the autoimmune disorder is multiple sclerosis (MS).

1642. The method of embodiment 1641, wherein the MS is relapsing-remitting MS (RRMS).

1643. The method of embodiment 1620, wherein the autoimmune disorder is glomerulonephritis.

1644. The method of embodiment 1620, wherein the autoimmune disorder is Goodpasture's syndrome.

1645. The method of embodiment 1620, wherein the autoimmune disorder is bullous pemphigoid.

1646. The method of embodiment 1620, wherein the autoimmune disorder is colitis ulcerosa.

1647. The method of embodiment 1620, wherein the autoimmune disorder is Guillain-Barré syndrome.

1648. The method of embodiment 1620, wherein the autoimmune disorder is chronic inflammatory demyelinating polyneuropathy.

1649. The method of embodiment 1620, wherein the autoimmune disorder is anti-phospholipid syndrome.

1650. The method of embodiment 1620, wherein the autoimmune disorder is narcolepsy.

1651. The method of embodiment 1620, wherein the autoimmune disorder is sarcoidosis.

1652. The method of embodiment 1620, wherein the autoimmune disorder is Wegener's granulomatosis.

1653. A nucleic acid or plurality of nucleic acids encoding the MBM of any one of embodiments 1 to 1395.

1654. The nucleic acid or plurality of nucleic acids of embodiment 1653 which is a DNA (are DNAs).

1655. The nucleic acid or plurality of nucleic acids of embodiment 1654 which are in the form of one or more vectors, optionally expression vectors.

1656. The nucleic acid or plurality of nucleic acids of embodiment 1653 which is a mRNA (are mRNAs).

1657. A cell engineered to express the MBM of any one of embodiments 1 to 1395.

1658. A cell transfected with one or more expression vectors comprising one or more nucleic acid sequences encoding the MBM of any one of embodiments 1 to 1395 under the control of one or more promoters.

1659. The cell of embodiment 1657 or embodiment 1658, wherein expression of the MBM is under the control of one or more inducible promoters.

1660. The cell of any one of embodiments 1657 to 1659, wherein the MBM is produced in secretable form.

1661. A method of producing a MBM, comprising:
(a) culturing the cell of any one of embodiments 1657 to 1660 in conditions under which the MBM is expressed; and
(b) recovering the MBM from the cell culture.

10. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes. In the event that there are any inconsistencies between the teachings of one or more of the references incorporated herein and the present disclosure, the teachings of the present specification are intended.

3. The MBM of claim 1, wherein ABM1 is an antibody, an antibody fragment, an scFv, a dsFv, a Fv, a Fab, an scFab, or a (Fab')2.

4. The MBM of claim 1, wherein the component of the TCR complex is CD3.

SEQUENCE LISTING (872 sequences)

SEQ ID NO: 1 - protein, 15 aa, Artificial Sequence
  source: /note="Description of Artificial Sequence: Synthetic peptide"
GGGGSGGGGSGGGGS

SEQ ID NO: 2 - protein, 4 aa, Artificial Sequence
  source: /note="Description of Artificial Sequence: Synthetic peptide"
CPPC

SEQ ID NO: 3 - protein, 4 aa, Artificial Sequence
  source: /note="Description of Artificial Sequence: Synthetic peptide"
SPPS

SEQ ID NO: 4 - protein, 19 aa, Homo sapiens
VPSTPPTPSPSTPPTPSPS

SEQ ID NO: 5 - protein, 6 aa, Homo sapiens
VPPPPP

SEQ ID NO: 6 - protein, 58 aa, Homo sapiens
ESPKAQASSVPTAQPQAEGSLAKATTAPATTRNTGRGGEEKKKEKEKEEQEERETKTP

SEQ ID NO: 7 - protein, 15 aa, Homo sapiens
EPKSCDKTHTCPPCP

SEQ ID NO: 8 - protein, 12 aa, Homo sapiens
ERKCCVECPPCP

SEQ ID NO: 9 - protein, 62 aa, Homo sapiens
ELKTPLGDTTHTCPRCPEPKSCDTPPPCPRCPEPKSCDTPPPCPRCPEPKSCDTPPPCPRCP

SEQ ID NO: 10 - protein, 12 aa, Homo sapiens
ESKYGPPCPSCP

SEQ ID NO: 11 - protein, 12 aa, Homo sapiens
ESKYGPPCPPCP

SEQ ID NO: 12 - protein, 4 aa, Artificial Sequence
  source: /note="Description of Artificial Sequence: Synthetic peptide"
CPSC

SEQ ID NO: 13 - protein, 4 aa, Artificial Sequence
  source: /note="Description of Artificial Sequence: Synthetic peptide"
CPRC

SEQ ID NO: 14 - protein, 4 aa, Artificial Sequence
  source: /note="Description of Artificial Sequence: Synthetic peptide"
SPPC

SEQ ID NO: 15 - protein, 4 aa, Artificial Sequence
  source: /note="Description of Artificial Sequence: Synthetic peptide"
CPPS

SEQ ID NO: 16 - protein, 8 aa, Artificial Sequence
  source: /note="Description of Artificial Sequence: Synthetic peptide"
DKTHTCAA

SEQ ID NO: 17 - protein, 11 aa, Artificial Sequence
  source: /note="Description of Artificial Sequence: Synthetic peptide"
DKTHTCPPCPA

SEQ ID NO: 18 - protein, 18 aa, Artificial Sequence
  source: /note="Description of Artificial Sequence: Synthetic peptide"
DKTHTCPPCPATCPPCPA

SEQ ID NO: 19 - protein, 25 aa, Artificial Sequence
  source: /note="Description of Artificial Sequence: Synthetic peptide"
DKTHTCPPCPATCPPCPATCPPCPA

SEQ ID NO: 20 - protein, 30 aa, Artificial Sequence
  source: /note="Description of Artificial Sequence: Synthetic polypeptide"
DKTHTCPPCPAGKPTLYNSLVMSDTAGTCY

SEQ ID NO: 21 - protein, 31 aa, Artificial Sequence
  source: /note="Description of Artificial Sequence: Synthetic polypeptide"
DKTHTCPPCPAGKPTHVNVSVVMAEVDGTCY

SEQ ID NO: 22 - protein, 15 aa, Artificial Sequence
  source: /note="Description of Artificial Sequence: Synthetic peptide"
DKTHTCCVECPPCPA

SEQ ID NO: 23 - protein, 26 aa, Artificial Sequence
  source: /note="Description of Artificial Sequence: Synthetic peptide"
DKTHTCPRCPEPKSCDTPPPCPRCPA

SEQ ID NO: 24 - protein, 11 aa, Artificial Sequence
  source: /note="Description of Artificial Sequence: Synthetic peptide"
DKTHTCPSCPA

SEQ ID NO: 25 - protein, 5 aa, Artificial Sequence
  source: /note="Description of Artificial Sequence: Synthetic peptide"
  source: /note="See specification as filed for detailed description of substitutions and preferred embodiments"
GGGGS

SEQ ID NO: 26 - protein, 5 aa, Artificial Sequence
  source: /note="Description of Artificial Sequence: Synthetic peptide"
ADAAP

SEQ ID NO: 27 - protein, 11 aa, Artificial Sequence
  source: /note="Description of Artificial Sequence: Synthetic peptide"
ADAAPTVSIFP

SEQ ID NO: 28 - protein, 12 aa, Artificial Sequence
  source: /note="Description of Artificial Sequence: Synthetic peptide"
ADAAPTVSIFPP

SEQ ID NO: 29 - protein, 6 aa, Artificial Sequence
  source: /note="Description of Artificial Sequence: Synthetic peptide"
AKTTAP

SEQ ID NO: 30 - protein, 13 aa, Artificial Sequence
  source: /note="Description of Artificial Sequence: Synthetic peptide"
AKTTAPSVYPLAP

SEQ ID NO: 31 - protein, 17 aa, Artificial Sequence
  source: /note="Description of Artificial Sequence: Synthetic peptide"
AKTTPKLEEGEFSEARV

SEQ ID NO: 32 - protein, 9 aa, Artificial Sequence
  source: /note="Description of Artificial Sequence: Synthetic peptide"
AKTTPKLGG

SEQ ID NO: 33 - protein, 6 aa, Artificial Sequence
  source: /note="Description of Artificial Sequence: Synthetic peptide"
AKTTPP

SEQ ID NO: 34 - protein, 13 aa, Artificial Sequence
  source: /note="Description of Artificial Sequence: Synthetic peptide"
AKTTPPSVTPLAP

SEQ ID NO: 35 - protein, 6 aa, Artificial Sequence
  source: /note="Description of Artificial Sequence: Synthetic peptide"
ASTKGP

SEQ ID NO: 36 - protein, 13 aa, Artificial Sequence
  source: /note="Description of Artificial Sequence: Synthetic peptide"
ASTKGPSVFPLAP

SEQ ID NO: 37 - protein, 26 aa, Artificial Sequence
  source: /note="Description of Artificial Sequence: Synthetic peptide"
ASTKGPSVFPLAPASTKGPSVFPLAP

SEQ ID NO: 38 - protein, 14 aa, Artificial Sequence
  source: /note="Description of Artificial Sequence: Synthetic peptide"
EGKSSGSGSESKST

SEQ ID NO: 39 - protein, 15 aa, Artificial Sequence
  source: /note="Description of Artificial Sequence: Synthetic peptide"
GEGESGEGESGEGES

SEQ ID NO: 40 - protein, 20 aa, Artificial Sequence
  source: /note="Description of Artificial Sequence: Synthetic peptide"
GEGESGEGESGEGESGEGES

SEQ ID NO: 41 - protein, 15 aa, Artificial Sequence
  source: /note="Description of Artificial Sequence: Synthetic peptide"
GEGGSGEGGSGEGGS

SEQ ID NO: 42 - protein, 15 aa, Artificial Sequence
  source: /note="Description of Artificial Sequence: Synthetic peptide"
GENKVEYAPALMALS

SEQ ID NO: 43 - protein, 15 aa, Artificial Sequence
  source: /note="Description of Artificial Sequence: Synthetic peptide"
GGEGSGGEGSGGEGS

SEQ ID NO: 44 - protein, 15 aa, Artificial Sequence
  source: /note="Description of Artificial Sequence: Synthetic peptide"
GGGESGGEGSGEGGS

SEQ ID NO: 45 - protein, 15 aa, Artificial Sequence
  source: /note="Description of Artificial Sequence: Synthetic peptide"
GGGESGGGESGGGES

SEQ ID NO: 46 - protein, 50 aa, Artificial Sequence
  source: /note="Description of Artificial Sequence: Synthetic polypeptide"
  SITE (1)..(50): /note="This sequence may encompass 1-10 'Gly Gly Gly Gly Ser' repeating units"
GGGGSGGGGSGGGGSGGGGSGGGGSGGGGSGGGGSGGGGSGGGGSGGGGS

SEQ ID NO: 47 - protein, 10 aa, Artificial Sequence
  source: /note="Description of Artificial Sequence: Synthetic peptide"
GGGGSGGGGS

SEQ ID NO: 48 - protein, 20 aa, Artificial Sequence
  source: /note="Description of Artificial Sequence: Synthetic peptide"
GGGGSGGGGSGGGGSGGGGS

SEQ ID NO: 49 - protein, 15 aa, Artificial Sequence
  source: /note="Description of Artificial Sequence: Synthetic peptide"
GGGKSGGGKSGGGKS

SEQ ID NO: 50 - protein, 15 aa, Artificial Sequence
  source: /note="Description of Artificial Sequence: Synthetic peptide"
GGGKSGGKGSGKGGS

SEQ ID NO: 51 - protein, 15 aa, Artificial Sequence
  source: /note="Description of Artificial Sequence: Synthetic peptide"
GGKGSGGKGSGGKGS

SEQ ID NO: 52 - protein, 5 aa, Artificial Sequence
  source: /note="Description of Artificial Sequence: Synthetic peptide"
GGSGG

SEQ ID NO: 53 - protein, 9 aa, Artificial Sequence
  source: /note="Description of Artificial Sequence: Synthetic peptide"
GGSGGGGSG

SEQ ID NO: 54 - protein, 13 aa, Artificial Sequence
  source: /note="Description of Artificial Sequence: Synthetic peptide"
GGSGGGGSGGGGS

SEQ ID NO: 55 - protein, 15 aa, Artificial Sequence
  source: /note="Description of Artificial Sequence: Synthetic peptide"
GHEAAAVMQVQYPAS

SEQ ID NO: 56 - protein, 15 aa, Artificial Sequence
  source: /note="Description of Artificial Sequence: Synthetic peptide"
GKGGSGKGGSGKGGS

SEQ ID NO: 57 - protein, 15 aa, Artificial Sequence
  source: /note="Description of Artificial Sequence: Synthetic peptide"
GKGKSGKGKSGKGKS

SEQ ID NO: 58 - protein, 20 aa, Artificial Sequence
  source: /note="Description of Artificial Sequence: Synthetic peptide"
GKGKSGKGKSGKGKSGKGKS

SEQ ID NO: 59 - protein, 15 aa, Artificial Sequence
  source: /note="Description of Artificial Sequence: Synthetic peptide"
GKPGSGKPGSGKPGS

SEQ ID NO: 60 - protein, 20 aa, Artificial Sequence
  source: /note="Description of Artificial Sequence: Synthetic peptide"
GKPGSGKPGSGKPGSGKPGS

SEQ ID NO: 61 - protein, 15 aa, Artificial Sequence
  source: /note="Description of Artificial Sequence: Synthetic peptide"
GPAKELTPLKEAKVS

SEQ ID NO: 62 - protein, 12 aa, Artificial Sequence
  source: /note="Description of Artificial Sequence: Synthetic peptide"
GSAGSAAGSGEF

SEQ ID NO: 63 - protein, 14 aa, Artificial Sequence
  source: /note="Description of Artificial Sequence: Synthetic peptide"
IRPRAIGGSKPRVA

SEQ ID NO: 64 - protein, 18 aa, Artificial Sequence
  source: /note="Description of Artificial Sequence: Synthetic peptide"
KESGSVSSEQLAQFRSLD

SEQ ID NO: 65 - protein, 15 aa, Artificial Sequence
  source: /note="Description of Artificial Sequence: Synthetic peptide"
KTTPKLEEGEFSEAR

SEQ ID NO: 66 - protein, 6 aa, Artificial Sequence
  source: /note="Description of Artificial Sequence: Synthetic peptide"
QPKAAP

SEQ ID NO: 67 - protein, 13 aa, Artificial Sequence
  source: /note="Description of Artificial Sequence: Synthetic peptide"
QPKAAPSVTLFPP

SEQ ID NO: 68 - protein, 27 aa, Artificial Sequence
  source: /note="Description of Artificial Sequence: Synthetic peptide"
RADAAAAGGGGSGGGGSGGGGSGGGGS

SEQ ID NO: 69 - protein, 12 aa, Artificial Sequence
  source: /note="Description of Artificial Sequence: Synthetic peptide"
RADAAAAGGPGS

SEQ ID NO: 70 - protein, 6 aa, Artificial Sequence
  source: /note="Description of Artificial Sequence: Synthetic peptide"
RADAAP

SEQ ID NO: 71 - protein, 9 aa, Artificial Sequence
  source: /note="Description of Artificial Sequence: Synthetic peptide"
RADAAPTVS

SEQ ID NO: 72 - protein, 6 aa, Artificial Sequence
  source: /note="Description of Artificial Sequence: Synthetic peptide"
SAKTTP

SEQ ID NO: 73 - protein, 18 aa, Artificial Sequence
  source: /note="Description of Artificial Sequence: Synthetic peptide"
SAKTTPKLEEGEFSEARV

SEQ ID NO: 74 - protein, 10 aa, Artificial Sequence
  source: /note="Description of Artificial Sequence: Synthetic peptide"
SAKTTPKLGG

SEQ ID NO: 75 - protein, 14 aa, Artificial Sequence
  source: /note="Description of Artificial Sequence: Synthetic peptide"
STAGDTHLGGEDFD

SEQ ID NO: 76 - protein, 5 aa, Artificial Sequence
  source: /note="Description of Artificial Sequence: Synthetic peptide"
TVAAP

SEQ ID NO: 77 - protein, 12 aa, Artificial Sequence
  source: /note="Description of Artificial Sequence: Synthetic peptide"
TVAAPSVFIFPP

SEQ ID NO: 78 - protein, 24 aa, Artificial Sequence
  source: /note="Description of Artificial Sequence: Synthetic peptide"
TVAAPSVFIFPPTVAAPSVFIFPP

SEQ ID NO: 79 - protein, 11 aa, Artificial Sequence
  source: /note="Description of Artificial Sequence: Synthetic peptide"
RASQSISSYLN

SEQ ID NO: 80 - protein, 7 aa, Artificial Sequence
  source: /note="Description of Artificial Sequence: Synthetic peptide"
SQSISSY

SEQ ID NO: 81 - protein, 6 aa, Artificial Sequence
  source: /note="Description of Artificial Sequence: Synthetic peptide"
QSISSY

SEQ ID NO: 82 - protein, 7 aa, Artificial Sequence
  source: /note="Description of Artificial Sequence: Synthetic peptide"
AASSLQS

SEQ ID NO: 83 - protein, 3 aa, Artificial Sequence
  source: /note="Description of Artificial Sequence: Synthetic peptide"
AAS

SEQ ID NO: 84 - protein, 9 aa, Artificial Sequence
  source: /note="Description of Artificial Sequence: Synthetic peptide"
  VARIANT (6)..(6): /replace="Thr"
  SITE (1)..(9): /note="Variant residues given in the sequence have no preference with respect to those in the annotations for variant positions"
QQSYSSPLT

SEQ ID NO: 85 - protein, 9 aa, Artificial Sequence
  source: /note="Description of Artificial Sequence: Synthetic peptide"
  VARIANT (5)..(5): /replace="Gly" or "Asp" or "Tyr" or "Ala"
  VARIANT (6)..(6): /replace="Thr" or "Ala"
  VARIANT (8)..(8): /replace="Leu"
  SITE (1)..(9): /note="Variant residues given in the sequence have no preference with respect to those in the annotations for variant positions"
QQSYSSPPT

SEQ ID NO: 86 - protein, 6 aa, Artificial Sequence
  source: /note="Description of Artificial Sequence: Synthetic peptide"
  VARIANT (4)..(4): /replace="Thr"
  SITE (1)..(6): /note="Variant residues given in the sequence have no preference with respect to those in the annotations for variant positions"
SYSSPL

SEQ ID NO: 87 - protein, 6 aa, Artificial Sequence
  source: /note="Description of Artificial Sequence: Synthetic peptide"
  VARIANT (3)..(3): /replace="Gly" or "Asp" or "Tyr" or "Ala"
  VARIANT (4)..(4): /replace="Thr" or "Ala"
  VARIANT (6)..(6): /replace="Leu"
  SITE (1)..(6): /note="Variant residues given in the sequence have no preference with respect to those in the annotations for variant positions"
SYSSPP

SEQ ID NO: 88 - protein, 5 aa, Artificial Sequence
  source: /note="Description of Artificial Sequence: Synthetic peptide"
SYAMS

SEQ ID NO: 89 - protein, 7 aa, Artificial Sequence
  source: /note="Description of Artificial Sequence: Synthetic peptide"
GFTFSSY

SEQ ID NO: 90 - protein, 8 aa, Artificial Sequence
  source: /note="Description of Artificial Sequence: Synthetic peptide"
GFTFSSYA

SEQ ID NO: 91 - protein, 10 aa, Artificial Sequence
  source: /note="Description of Artificial Sequence: Synthetic peptide"
GFTFSSYAMS

SEQ ID NO: 92 - protein, 17 aa, Artificial Sequence
  source: /note="Description of Artificial Sequence: Synthetic peptide"
  VARIANT (4)..(4): /replace="Glu"
  VARIANT (8)..(8): /replace="Arg"
  VARIANT (9)..(9): /replace="Ala"
  VARIANT (10)..(10): /replace="Ala"
  SITE (1)..(17): /note="Variant residues given in the sequence have no preference with respect to those in the annotations for variant positions"
AISGSGGSTYYADSVKG

SEQ ID NO: 93 - protein, 17 aa, Artificial Sequence
  source: /note="Description of Artificial Sequence: Synthetic peptide"
  VARIANT (4)..(4): /replace="Glu" or "Ala"
  VARIANT (5)..(5): /replace="Ala" or "His" or "Glu"
  VARIANT (7)..(7): /replace="Asp" or "Glu" or "His" or "Arg" or "Ala"
  VARIANT (8)..(8): /replace="Arg" or "Val" or "Thr" or "Tyr"
  VARIANT (9)..(9): /replace="Ala" or "Glu" or "His" or "Arg"
  VARIANT (10)..(10): /replace="Ala" or "Ser"
  SITE (1)..(17): /note="Variant residues given in the sequence have no preference with respect to those in the annotations for variant positions"
AISGSGGSTYYADSVKG

SEQ ID NO: 94 - protein, 6 aa, Artificial Sequence
  source: /note="Description of Artificial Sequence: Synthetic peptide"
  VARIANT (2)..(2): /replace="Glu"
  VARIANT (6)..(6): /replace="Arg"
  SITE (1)..(6): /note="Variant residues given in the sequence have no preference with respect to those in the annotations for variant positions"
SGSGGS

SEQ ID NO: 95 - protein, 6 aa, Artificial Sequence
  source: /note="Description of Artificial Sequence: Synthetic peptide"
  VARIANT (2)..(2): /replace="Glu" or "Ala"
  VARIANT (3)..(3): /replace="Ala" or "His" or "Glu"
  VARIANT (5)..(5): /replace="Asp" or "Glu" or "His" or "Arg" or "Ala"
  VARIANT (6)..(6): /replace="Arg" or "Val" or "Thr" or "Tyr"
  SITE (1)..(6): /note="Variant residues given in the sequence have no preference with respect to those in the annotations for variant positions"
SGSGGS

SEQ ID NO: 96 - protein, 8 aa, Artificial Sequence
  source: /note="Description of Artificial Sequence: Synthetic peptide"
  VARIANT (3)..(3): /replace="Glu"
  VARIANT (7)..(7): /replace="Arg"
  VARIANT (8)..(8): /replace="Ala"
  SITE (1)..(8): /note="Variant residues given in the sequence have no preference with respect to those in the annotations for variant positions"
ISGSGGST

SEQ ID NO: 97 - protein, 8 aa, Artificial Sequence
  source: /note="Description of Artificial Sequence: Synthetic peptide"
  VARIANT (3)..(3): /replace="Glu" or "Ala"
  VARIANT (4)..(4): /replace="Ala" or "His" or "Glu"
  VARIANT (6)..(6): /replace="Asp" or "Glu" or "His" or "Arg" or "Ala"
  VARIANT (7)..(7): /replace="Arg" or "Val" or "Thr" or "Tyr"
  VARIANT (8)..(8): /replace="Ala" or "Glu" or "His" or "Arg"
  SITE (1)..(8): /note="Variant residues given in the sequence have no preference with respect to those in the annotations for variant positions"
ISGSGGST

SEQ ID NO: 98 - protein, 12 aa, Artificial Sequence
  source: /note="Description of Artificial Sequence: Synthetic peptide"
REWWYDDWYLDY

SEQ ID NO: 99 - protein, 14 aa, Artificial Sequence
  source: /note="Description of Artificial Sequence: Synthetic peptide"
ARREWWYDDWYLDY

SEQ ID NO: 100 - protein, 14 aa, Artificial Sequence
  source: /note="Description of Artificial Sequence: Synthetic peptide"
TGTSSDVGGYNYVS

SEQ ID NO: 101 - protein, 10 aa, Artificial Sequence
  source: /note="Description of Artificial Sequence: Synthetic peptide"
TSSDVGGYNY

SEQ ID NO: 102 - protein, 9 aa, Artificial Sequence
  source: /note="Description of Artificial Sequence: Synthetic peptide"
SSDVGGYNY

SEQ ID NO: 103 - protein, 7 aa, Artificial Sequence
  source: /note="Description of Artificial Sequence: Synthetic peptide"
  VARIANT (6)..(6): /replace="Pro"
  VARIANT (7)..(7): /replace="Ser"
  SITE (1)..(7): /note="Variant residues given in the sequence have no preference with respect to those in the annotations for variant positions"
DVSNRLR

SEQ ID NO: 104 - protein, 7 aa, Artificial Sequence
  source: /note="Description of Artificial Sequence: Synthetic peptide"
  VARIANT (1)..(1): /replace="Glu"
  VARIANT (6)..(6): /replace="Pro" or "Ala"
  VARIANT (7)..(7): /replace="Ser" or "Gly" or "Trp"
  SITE (1)..(7): /note="Variant residues given in the sequence have no preference with respect to those in the annotations for variant positions"
DVSNRLR

SEQ ID NO: 105 - protein, 3 aa, Artificial Sequence
  source: /note="Description of Artificial Sequence: Synthetic peptide"
DVS

SEQ ID NO: 106 - protein, 3 aa, Artificial Sequence
  source: /note="Description of Artificial Sequence: Synthetic peptide"
  VARIANT (1)..(1): /replace="Glu"
  SITE (1)..(3): /note="Variant residues given in the sequence have no preference with respect to those in the annotations for variant positions"
DVS

SEQ ID NO: 107 - protein, 10 aa, Artificial Sequence
  source: /note="Description of Artificial Sequence: Synthetic peptide"
  VARIANT (6)..(6): /replace="Pro"
  VARIANT (7)..(7): /replace="Ser"
  SITE (1)..(10): /note="Variant residues given in the sequence have no preference with respect to those in the annotations for variant positions"
DVSNRLRGVS

SEQ ID NO: 108 - protein, 10 aa, Artificial Sequence
  source: /note="Description of Artificial Sequence: Synthetic peptide"
  VARIANT (1)..(1): /replace="Glu"
  VARIANT (6)..(6): /replace="Pro" or "Ala"
  VARIANT (7)..(7): /replace="Ser" or "Gly" or "Trp"
  SITE (1)..(10): /note="Variant residues given in the sequence have no preference with respect to those in the annotations for variant positions"
DVSNRLRGVS

SEQ ID NO: 109 - protein, 3 aa, Artificial Sequence
  source: /note="Description of Artificial Sequence: Synthetic peptide"
  VARIANT (1)..(1): /replace="Glu"
  SITE (1)..(3): /note="Variant residues given in the sequence have no preference with respect to those in the annotations for variant positions"
DVS

SEQ ID NO: 110 - protein, 11 aa, Artificial Sequence
  source: /note="Description of Artificial Sequence: Synthetic peptide"
  VARIANT (8)..(8): /replace="Thr"
  SITE (1)..(11): /note="Variant residues given in the sequence have no preference with respect to those in the annotations for variant positions"
SSYTSSSALYV

SEQ ID NO: 111 - protein, 8 aa, Artificial Sequence
  source: /note="Description of Artificial Sequence: Synthetic peptide"
  VARIANT (6)..(6): /replace="Thr"
  SITE (1)..(8): /note="Variant residues given in the sequence have no preference with respect to those in the annotations for variant positions"
YTSSSALY

SEQ ID NO: 112 - protein, 5 aa, Artificial Sequence
  source: /note="Description of Artificial Sequence: Synthetic peptide"
SYGMH

SEQ ID NO: 113 - protein, 7 aa, Artificial Sequence
  source: /note="Description of Artificial Sequence: Synthetic peptide"
  VARIANT (4)..(4): /replace="Phe"
  SITE (1)..(7): /note="Variant residues given in the sequence have no preference with respect to those in the annotations for variant positions"
GFTVSSY

SEQ ID NO: 114 - protein, 8 aa, Artificial Sequence
  source: /note="Description of Artificial Sequence: Synthetic peptide"
  VARIANT (4)..(4): /replace="Phe"
  SITE (1)..(8): /note="Variant residues given in the sequence have no preference with respect to those in the annotations for variant positions"
GFTVSSYG

SEQ ID NO: 115 - protein, 10 aa, Artificial Sequence
  source: /note="Description of Artificial Sequence: Synthetic peptide"
  VARIANT (4)..(4): /replace="Phe"
  SITE (1)..(10): /note="Variant residues given in the sequence have no preference with respect to those in the annotations for variant positions"
GFTVSSYGMH

SEQ ID NO: 116 - protein, 17 aa, Artificial Sequence
  source: /note="Description of Artificial Sequence: Synthetic peptide"
  VARIANT (5)..(5): /replace="Asp"
  SITE (1)..(17): /note="Variant residues given in the sequence have no preference with respect to those in the annotations for variant positions"
VISYTGSNKYYADSVKG

SEQ ID NO: 117 - protein, 17 aa, Artificial Sequence
  source: /note="Description of Artificial Sequence: Synthetic peptide"
  VARIANT (5)..(5): /replace="Lys" or "Thr" or "Arg" or "Asp" or "Asn" or "Ser"
  VARIANT (6)..(6): /replace="Asp" or "Glu"
  VARIANT (7)..(7): /replace="Thr" or "Phe" or "Ala" or "Leu"
  VARIANT (8)..(8): /replace="Asn" or "Lys"
  SITE (1)..(17): /note="Variant residues given in the sequence have no preference with respect to those in the annotations for variant positions"
VISYHGSHKYYADSVKG

SEQ ID NO: 118 - protein, 6 aa, Artificial Sequence
  source: /note="Description of Artificial Sequence: Synthetic peptide"
  VARIANT (3)..(3): /replace="Asp"
  SITE (1)..(6): /note="Variant residues given in the sequence have no preference with respect to those in the annotations for variant positions"
SYTGSN

SEQ ID NO: 119 - protein, 8 aa, Artificial Sequence
  source: /note="Description of Artificial Sequence: Synthetic peptide"
  VARIANT (3)..(3): /replace="Lys" or "Thr" or "Arg" or "Asp" or "Asn" or "Ser"
  VARIANT (4)..(4): /replace="Asp" or "Glu"
  VARIANT (5)..(5): /replace="Thr" or "Phe" or "Ala" or "Leu"
  VARIANT (6)..(6): /replace="Asn" or "Lys"
  SITE (1)..(8): /note="Variant residues given in the sequence have no preference with respect to those in the annotations for variant positions"
SYHGSHKG

SEQ ID NO: 120 - protein, 8 aa, Artificial Sequence
  source: /note="Description of Artificial Sequence: Synthetic peptide"
  VARIANT (4)..(4): /replace="Asp"
  SITE (1)..(8): /note="Variant residues given in the sequence have no preference with respect to those in the annotations for variant positions"
ISYTGSNK

SEQ ID NO: 121 - protein, 8 aa, Artificial Sequence
  source: /note="Description of Artificial Sequence: Synthetic peptide"
  VARIANT (4)..(4): /replace="Lys" or "Thr" or "Arg" or "Asp" or "Asn" or "Ser"
  VARIANT (5)..(5): /replace="Asp" or "Glu"
  VARIANT (6)..(6): /replace="Thr" or "Phe" or "Ala" or "Leu"
  VARIANT (7)..(7): /replace="Asn" or "Lys"
  SITE (1)..(8): /note="Variant residues given in the sequence have no preference with respect to those in the annotations for variant positions"
ISYHGSHK

SEQ ID NO: 122 - protein, 14 aa, Artificial Sequence
  source: /note="Description of Artificial Sequence: Synthetic peptide"
SGYALHDDYYGLDV

SEQ ID NO: 123 - protein, 14 aa, Artificial Sequence
  source: /note="Description of Artificial Sequence: Synthetic peptide"
  VARIANT (4)..(4): /replace="Asn" or "Glu"
  VARIANT (5)..(5): /replace="Phe" or "Val" or "Tyr"
  VARIANT (6)..(6): /replace="Gln" or "Arg" or "Asp"
  VARIANT (7)..(7): /replace="Glu" or "Gly" or "Gln"
  VARIANT (8)..(8): /replace="Gln" or "Phe"
  VARIANT (9)..(9): /replace="Gln"
  VARIANT (10)..(10): /replace="Lys" or "Asp"
  VARIANT (11)..(11): /replace="Pro"
  VARIANT (12)..(12): /replace="Gln" or "Val" or "Thr"
  SITE (1)..(14): /note="Variant residues given in the sequence have no preference with respect to those in the annotations for variant positions"
SGYALHDDYYGLDV

SEQ ID NO: 124 - protein, 16 aa, Artificial Sequence
  source: /note="Description of Artificial Sequence: Synthetic peptide"
GGSGYALHDDYYGLDV

SEQ ID NO: 125 - protein, 16 aa, Artificial Sequence
  source: /note="Description of Artificial Sequence: Synthetic peptide"
  VARIANT (6)..(6): /replace="Asn" or "Glu"
  VARIANT (7)..(7): /replace="Phe" or "Val" or "Tyr"
  VARIANT (8)..(8): /replace="Gln" or "Arg" or "Asp"
  VARIANT (9)..(9): /replace="Glu" or "Gly" or "Gln"
  VARIANT (10)..(10): /replace="Gln" or "Phe"
  VARIANT (11)..(11): /replace="Gln"
  VARIANT (12)..(12): /replace="Lys" or "Asp"
  VARIANT (13)..(13): /replace="Pro"
  VARIANT (14)..(14): /replace="Gln" or "Val" or "Thr"
  SITE (1)..(16): /note="Variant residues given in the sequence have no preference with respect to those in the annotations for variant positions"
GGSGYALHDDYYGLDV

SEQ ID NO: 126 - protein, 9 aa, Artificial Sequence
  source: /note="Description of Artificial Sequence: Synthetic peptide"
QQSYSSPLT

SEQ ID NO: 127 - protein, 9 aa, Artificial Sequence
  source: /note="Description of Artificial Sequence: Synthetic peptide"
QQSYSTPLT

SEQ ID NO: 128 - protein, 9 aa, Artificial Sequence
  source: /note="Description of Artificial Sequence: Synthetic peptide"
QQSYGSPPT

SEQ ID NO: 129 - protein, 9 aa, Artificial Sequence
  source: /note="Description of Artificial Sequence: Synthetic peptide"
QQSYDSPLT

SEQ ID NO: 130 - protein, 9 aa, Artificial Sequence
  source: /note="Description of Artificial Sequence: Synthetic peptide"
QQSYYSPLT

SEQ ID NO: 131 - protein, 9 aa, Artificial Sequence
  source: /note="Description of Artificial Sequence: Synthetic peptide"
QQSYYAPLT

SEQ ID NO: 132 - protein, 9 aa, Artificial Sequence
  source: /note="Description of Artificial Sequence: Synthetic peptide"
QQSYASPLT

SEQ ID NO: 133 - protein, 9 aa, Artificial Sequence
  source: /note="Description of Artificial Sequence: Synthetic peptide"
QQSYGSPLT

SEQ ID NO: 134 - protein, 9 aa, Artificial Sequence
  source: /note="Description of Artificial Sequence: Synthetic peptide"
QQSYDAPLT

SEQ ID NO: 135 - protein, 17 aa, Artificial Sequence
  source: /note="Description of Artificial Sequence: Synthetic peptide"
AISGSGGSTYYADSVKG

SEQ ID NO: 136 - protein, 17 aa, Artificial Sequence
  source: /note="Description of Artificial Sequence: Synthetic peptide"
AISESGGRAAYADSVKG

SEQ ID NO: 137 - protein, 17 aa, Artificial Sequence
  source: /note="Description of Artificial Sequence: Synthetic peptide"
AISGSGGRAAYADSVKG

SEQ ID NO: 138 - protein, 17 aa, Artificial Sequence
  source: /note="Description of Artificial Sequence: Synthetic peptide"
AISESGDVEAYADSVKG

SEQ ID NO: 139 - protein, 17 aa, Artificial Sequence
  source: /note="Description of Artificial Sequence: Synthetic peptide"
AISEAGETTSYADSVKG

SEQ ID NO: 140 - protein, 17 aa, Artificial Sequence
  source: /note="Description of Artificial Sequence: Synthetic peptide"
AISEHGHYTSYADSVKG

SEQ ID NO: 141 - protein, 17 aa, Artificial Sequence
  source: /note="Description of Artificial Sequence: Synthetic peptide"
AISGSGHTAAYADSVKG

SEQ ID NO: 142 - protein, 17 aa, Artificial Sequence
  source: /note="Description of Artificial Sequence: Synthetic peptide"
AISGSGRTHAYADSVKG

SEQ ID NO: 143 - protein, 17 aa, Artificial Sequence
  source: /note="Description of Artificial Sequence: Synthetic peptide"
AISAEGGVRAYADSVKG

SEQ ID NO: 144 - protein, 17 aa, Artificial Sequence
  source: /note="Description of Artificial Sequence: Synthetic peptide"
AISGSGGTTAYADSVKG

SEQ ID NO: 145 - protein, 17 aa, Artificial Sequence
  source: /note="Description of Artificial Sequence: Synthetic peptide"
AISGSGATTAYADSVKG

SEQ ID NO: 146 - protein, 6 aa, Artificial Sequence
  source: /note="Description of Artificial Sequence: Synthetic peptide"
SYSSPL

SEQ ID NO: 147 - protein, 6 aa, Artificial Sequence
  source: /note="Description of Artificial Sequence: Synthetic peptide"
SYSTPL

SEQ ID NO: 148 - protein, 6 aa, Artificial Sequence
  source: /note="Description of Artificial Sequence: Synthetic peptide"
SYGSPP

SEQ ID NO: 149 - protein, 6 aa, Artificial Sequence
  source: /note="Description of Artificial Sequence: Synthetic peptide"
SYDSPL

SEQ ID NO: 150 - protein, 6 aa, Artificial Sequence
  source: /note="Description of Artificial Sequence: Synthetic peptide"
SYYSPL

SEQ ID NO: 151 - protein, 6 aa, Artificial Sequence
  source: /note="Description of Artificial Sequence: Synthetic peptide"
SYYAPL

SEQ ID NO: 152 - protein, 6 aa, Artificial Sequence
  source: /note="Description of Artificial Sequence: Synthetic peptide"
SYASPL

SEQ ID NO: 153 - protein, 6 aa, Artificial Sequence
  source: /note="Description of Artificial Sequence: Synthetic peptide"
SYGSPL

SEQ ID NO: 154 - protein, 6 aa, Artificial Sequence
  source: /note="Description of Artificial Sequence: Synthetic peptide"
SYDAPL

SEQ ID NO: 155 - protein, 6 aa, Artificial Sequence
  source: /note="Description of Artificial Sequence: Synthetic peptide"
SGSGGS

SEQ ID NO: 156 - protein, 6 aa, Artificial Sequence
  source: /note="Description of Artificial Sequence: Synthetic peptide"
SESGGR

SEQ ID NO: 157 - protein, 6 aa, Artificial Sequence
  source: /note="Description of Artificial Sequence: Synthetic peptide"
SGSGGR

SEQ ID NO: 158 - protein, 6 aa, Artificial Sequence
  source: /note="Description of Artificial Sequence: Synthetic peptide"
SESGDV

SEQ ID NO: 159 - protein, 6 aa, Artificial Sequence
  source: /note="Description of Artificial Sequence: Synthetic peptide"
SEHGHY

SEQ ID NO: 160 - protein, 6 aa, Artificial Sequence
  source: /note="Description of Artificial Sequence: Synthetic peptide"
SGSGHT

SEQ ID NO: 161 - protein, 6 aa, Artificial Sequence
  source: /note="Description of Artificial Sequence: Synthetic peptide"
SGSGRT

SEQ ID NO: 162 - protein, 6 aa, Artificial Sequence
  source: /note="Description of Artificial Sequence: Synthetic peptide"
SAEGGV

SEQ ID NO: 163 - protein, 6 aa, Artificial Sequence
  source: /note="Description of Artificial Sequence: Synthetic peptide"
SGSGGT

SEQ ID NO: 164 - protein, 6 aa, Artificial Sequence
  source: /note="Description of Artificial Sequence: Synthetic peptide"
SGSGAT

SEQ ID NO: 165 - protein, 8 aa, Artificial Sequence
  source: /note="Description of Artificial Sequence: Synthetic peptide"
ISGSGGST

SEQ ID NO: 166 - protein, 8 aa, Artificial Sequence
  source: /note="Description of Artificial Sequence: Synthetic peptide"
ISESGGRA

SEQ ID NO: 167 - protein, 8 aa, Artificial Sequence
  source: /note="Description of Artificial Sequence: Synthetic peptide"
ISGSGGRA

SEQ ID NO: 168 - protein, 8 aa, Artificial Sequence
  source: /note="Description of Artificial Sequence: Synthetic peptide"
ISESGDVE

SEQ ID NO: 169 - protein, 8 aa, Artificial Sequence
  source: /note="Description of Artificial Sequence: Synthetic peptide"
ISEHGHYT

SEQ ID NO: 170 - protein, 8 aa, Artificial Sequence
  source: /note="Description of Artificial Sequence: Synthetic peptide"
ISGSGHTA

SEQ ID NO: 171 - protein, 8 aa, Artificial Sequence
  source: /note="Description of Artificial Sequence: Synthetic peptide"
ISGSGRTH

SEQ ID NO: 172 - protein, 8 aa, Artificial Sequence
  source: /note="Description of Artificial Sequence: Synthetic peptide"
ISAEGGVR

SEQ ID NO: 173 - protein, 8 aa, Artificial Sequence
  source: /note="Description of Artificial Sequence: Synthetic peptide"
ISGSGGTT

SEQ ID NO: 174 - protein, 8 aa, Artificial Sequence
  source: /note="Description of Artificial Sequence: Synthetic peptide"
ISGSGATT

SEQ ID NO: 175 - protein, 7 aa, Artificial Sequence
  source: /note="Description of Artificial Sequence: Synthetic peptide"
DVSNRLR

SEQ ID NO: 176 - protein, 7 aa, Artificial Sequence
  source: /note="Description of Artificial Sequence: Synthetic peptide"
DVSNRPS

SEQ ID NO: 177 - protein, 7 aa, Artificial Sequence
  source: /note="Description of Artificial Sequence: Synthetic peptide"
EVSNRLS

SEQ ID NO: 178 - protein, 7 aa, Artificial Sequence
  source: /note="Description of Artificial Sequence: Synthetic peptide"
EVSNRLR

SEQ ID NO: 179 - protein, 7 aa, Artificial Sequence
  source: /note="Description of Artificial Sequence: Synthetic peptide"
DVSNRPW

SEQ ID NO: 180 - protein, 7 aa, Artificial Sequence
  source: /note="Description of Artificial Sequence: Synthetic peptide"
DVSNRLS

SEQ ID NO: 181 - protein, 7 aa, Artificial Sequence
  source: /note="Description of Artificial Sequence: Synthetic peptide"
DVSNRAW

SEQ ID NO: 182 - protein, 7 aa, Artificial Sequence
  source: /note="Description of Artificial Sequence: Synthetic peptide"
EVSNRLG

SEQ ID NO: 183 - protein, 11 aa, Artificial Sequence
  source: /note="Description of Artificial Sequence: Synthetic peptide"
SSYTSSSALYV

SEQ ID NO: 184 - protein, 11 aa, Artificial Sequence
  source: /note="Description of Artificial Sequence: Synthetic peptide"
SSYTSSSTLYV

SEQ ID NO: 185 - protein, 17 aa, Artificial Sequence
  source: /note="Description of Artificial Sequence: Synthetic peptide"
VISYTGSNKYYADSVKG

SEQ ID NO: 186 - protein, 17 aa, Artificial Sequence
  source: /note="Description of Artificial Sequence: Synthetic peptide"
VISYDGSNKYYADSVKG

SEQ ID NO: 187 - protein, 17 aa, Artificial Sequence
  source: /note="Description of Artificial Sequence: Synthetic peptide"
VISYHGSNKYYADSVKG

SEQ ID NO: 188 - protein, 17 aa, Artificial Sequence
  source: /note="Description of Artificial Sequence: Synthetic peptide"
VISYKGSNKYYADSVKG

SEQ ID NO: 189 - protein, 17 aa, Artificial Sequence
  source: /note="Description of Artificial Sequence: Synthetic peptide"
VISYTGTKKYYADSVKG

SEQ ID NO: 190 - protein, 17 aa, Artificial Sequence
  source: /note="Description of Artificial Sequence: Synthetic peptide"
VISYRGFNKYYADSVKG

SEQ ID NO: 191 - protein, 17 aa, Artificial Sequence
  source: /note="Description of Artificial Sequence: Synthetic peptide"
VISYKGSHKYYADSVKG

SEQ ID NO: 192 - protein, 17 aa, Artificial Sequence
  source: /note="Description of Artificial Sequence: Synthetic peptide"
VISYDDAHKYYADSVKG

SEQ ID NO: 193 - protein, 17 aa, Artificial Sequence
  source: /note="Description of Artificial Sequence: Synthetic peptide"
VISYNDLNKYYADSVKG

SEQ ID NO: 194 - protein, 17 aa, Artificial Sequence
  source: /note="Description of Artificial Sequence: Synthetic peptide"
VISYSGSNKYYADSVKG

SEQ ID NO: 195 - protein, 17 aa, Artificial Sequence
  source: /note="Description of Artificial Sequence: Synthetic peptide"
VISYTGANKYYADSVKG

SEQ ID NO: 196 - protein, 17 aa, Artificial Sequence
  source: /note="Description of Artificial Sequence: Synthetic peptide"
VISYNDANKYYADSVKG

SEQ ID NO: 197 - protein, 17 aa, Artificial Sequence
  source: /note="Description of Artificial Sequence: Synthetic peptide"
VISYDESNKYYADSVKG

SEQ ID NO: 198 - protein, 17 aa, Artificial Sequence
  source: /note="Description of Artificial Sequence: Synthetic peptide"
VISYDDANKYYADSVKG

SEQ ID NO: 199 - protein, 14 aa, Artificial Sequence
  source: /note="Description of Artificial Sequence: Synthetic peptide"
SGYALHDDYYGQDV

SEQ ID NO: 200 - protein, 14 aa, Artificial Sequence
  source: /note="Description of Artificial Sequence: Synthetic peptide"
SGYALHDQYKPVDV

SEQ ID NO: 201 - protein, 14 aa, Artificial Sequence
  source: /note="Description of Artificial Sequence: Synthetic peptide"
SGYALHDFQDPTDV

SEQ ID NO: 202 - protein, 14 aa, Artificial Sequence
  source: /note="Description of Artificial Sequence: Synthetic peptide"
SGYNLHDDYYGLDV

SEQ ID NO: 203 - protein, 14 aa, Artificial Sequence
  source: /note="Description of Artificial Sequence: Synthetic peptide"
SGYEFHEDYYGLDV

SEQ ID NO: 204 - protein, 14 aa, Artificial Sequence
  source: /note="Description of Artificial Sequence: Synthetic peptide"
SGYEFQGDYYGLDV

SEQ ID NO: 205 - protein, 14 aa, Artificial Sequence
  source: /note="Description of Artificial Sequence: Synthetic peptide"
SGYELRDDYYGLDV

SEQ ID NO: 206 - protein, 14 aa, Artificial Sequence
  source: /note="Description of Artificial Sequence: Synthetic peptide"
SGYEVDQDYYGLDV

SEQ ID NO: 207 - protein, 14 aa, Artificial Sequence
  source: /note="Description of Artificial Sequence: Synthetic peptide"
SGYAYDGDYYGLDV

SEQ ID NO: 208 - protein, 3 aa, Artificial Sequence
  source: /note="Description of Artificial Sequence: Synthetic peptide"
EVS

SEQ ID NO: 209 - protein, 8 aa, Artificial Sequence
  source: /note="Description of Artificial Sequence: Synthetic peptide"
YTSSSALY

SEQ ID NO: 210 - protein, 8 aa, Artificial Sequence
  source: /note="Description of Artificial Sequence: Synthetic peptide"
YTSSSTLY

SEQ ID NO: 211 - protein, 7 aa, Artificial Sequence
  source: /note="Description of Artificial Sequence: Synthetic peptide"
GFTVSSY

SEQ ID NO: 212 - protein, 7 aa, Artificial Sequence
  source: /note="Description of Artificial Sequence: Synthetic peptide"
GFTLSSY

SEQ ID NO: 213 - protein, 6 aa, Artificial Sequence
  source: /note="Description of Artificial Sequence: Synthetic peptide"
SYTGSN

SEQ ID NO: 214 - protein, 6 aa, Artificial Sequence
  source: /note="Description of Artificial Sequence: Synthetic peptide"
SYDGSN

SEQ ID NO: 215 - protein, 6 aa, Artificial Sequence
  source: /note="Description of Artificial Sequence: Synthetic peptide"
SYHGSN

SEQ ID NO: 216 - protein, 6 aa, Artificial Sequence
  source: /note="Description of Artificial Sequence: Synthetic peptide"
SYKGSN

SEQ ID NO: 217 - protein, 6 aa, Artificial Sequence
  source: /note="Description of Artificial Sequence: Synthetic peptide"
SYTGTK

SEQ ID NO: 218 - protein, 6 aa, Artificial Sequence
  source: /note="Description of Artificial Sequence: Synthetic peptide"
SYRGFN

SEQ ID NO: 219 - protein, 6 aa, Artificial Sequence
  source: /note="Description of Artificial Sequence: Synthetic peptide"
SYKGSH

SEQ ID NO: 220 - protein, 6 aa, Artificial Sequence
  source: /note="Description of Artificial Sequence: Synthetic peptide"
SYDDAH

SEQ ID NO: 221 - protein, 6 aa, Artificial Sequence
  source: /note="Description of Artificial Sequence: Synthetic peptide"
SYNDLN

SEQ ID NO: 222 - protein, 6 aa, Artificial Sequence
  source: /note="Description of Artificial Sequence: Synthetic peptide"
SYSGSN

SEQ ID NO: 223 - protein, 6 aa, Artificial Sequence
  source: /note="Description of Artificial Sequence: Synthetic peptide"
SYTGAN

SEQ ID NO: 224 - protein, 6 aa, Artificial Sequence
  source: /note="Description of Artificial Sequence: Synthetic peptide"
SYNDAN

SEQ ID NO: 225 - protein, 6 aa, Artificial Sequence
  source: /note="Description of Artificial Sequence: Synthetic peptide"
SYDESN

SEQ ID NO: 226 - protein, 6 aa, Artificial Sequence
  source: /note="Description of Artificial Sequence: Synthetic peptide"
SYDDAN

SEQ ID NO: 227 - protein, 10 aa, Artificial Sequence
  source: /note="Description of Artificial Sequence: Synthetic peptide"
DVSNRLRGVS

SEQ ID NO: 228 - protein, 10 aa, Artificial Sequence
  source: /note="Description of Artificial Sequence: Synthetic peptide"
DVSNRPSGVS

SEQ ID NO: 229 - protein, 10 aa, Artificial Sequence
  source: /note="Description of Artificial Sequence: Synthetic peptide"
EVSNRLSGVS

SEQ ID NO: 230 - protein, 10 aa, Artificial Sequence
  source: /note="Description of Artificial Sequence: Synthetic peptide"
EVSNRLRGVS

SEQ ID NO: 231 - protein, 10 aa, Artificial Sequence
  source: /note="Description of Artificial Sequence: Synthetic peptide"
DVSNRPWGVS

SEQ ID NO: 232 - protein, 10 aa, Artificial Sequence
  source: /note="Description of Artificial Sequence: Synthetic peptide"
DVSNRLSGVS

SEQ ID NO: 233 - protein, 10 aa, Artificial Sequence
  source: /note="Description of Artificial Sequence: Synthetic peptide"
DVSNRAWGVS

SEQ ID NO: 234 - protein, 10 aa, Artificial Sequence
  source: /note="Description of Artificial Sequence: Synthetic peptide"
EVSNRLGGVS

SEQ ID NO: 235 - protein, 8 aa, Artificial Sequence
  source: /note="Description of Artificial Sequence: Synthetic peptide"
GFTVSSYG

SEQ ID NO: 236 - protein, 8 aa, Artificial Sequence
  source: /note="Description of Artificial Sequence: Synthetic peptide"
GFTFSSYG

SEQ ID NO: 237 - protein, 8 aa, Artificial Sequence
  source: /note="Description of Artificial Sequence: Synthetic peptide"
GFTLSSYG

SEQ ID NO: 238 - protein, 8 aa, Artificial Sequence
  source: /note="Description of Artificial Sequence: Synthetic peptide"
ISYTGSNK

SEQ ID NO: 239 - protein, 8 aa, Artificial Sequence
  source: /note="Description of Artificial Sequence: Synthetic peptide"
ISYDGSNK

SEQ ID NO: 240 - protein, 8 aa, Artificial Sequence
  source: /note="Description of Artificial Sequence: Synthetic peptide"
ISYHGSNK

SEQ ID NO: 241 - protein, 8 aa, Artificial Sequence
  source: /note="Description of Artificial Sequence: Synthetic peptide"
ISYKGSNK

SEQ ID NO: 242 - protein, 8 aa, Artificial Sequence
  source: /note="Description of Artificial Sequence: Synthetic peptide"
ISYTGTKK

SEQ ID NO: 243 - protein, 8 aa, Artificial Sequence
  source: /note="Description of Artificial Sequence: Synthetic peptide"
ISYRGFNK

SEQ ID NO: 244 - protein, 8 aa, Artificial Sequence
  source: /note="Description of Artificial Sequence: Synthetic peptide"
ISYKGSHK

SEQ ID NO: 245 - protein, 8 aa, Artificial Sequence
  source: /note="Description of Artificial Sequence: Synthetic peptide"
ISYDDAHK

SEQ ID NO: 246 - protein, 8 aa, Artificial Sequence
  source: /note="Description of Artificial Sequence: Synthetic peptide"
ISYNDLNK

SEQ ID NO: 247 - protein, 8 aa, Artificial Sequence
  source: /note="Description of Artificial Sequence: Synthetic peptide"
ISYSGSNK

SEQ ID NO: 248 - protein, 8 aa, Artificial Sequence
  source: /note="Description of Artificial Sequence: Synthetic peptide"
ISYTGANK

SEQ ID NO: 249 - protein, 8 aa, Artificial Sequence
  source: /note="Description of Artificial Sequence: Synthetic peptide"
ISYNDANK

SEQ ID NO: 250 - protein, 8 aa, Artificial Sequence
  source: /note="Description of Artificial Sequence: Synthetic peptide"
ISYDESNK

SEQ ID NO: 251 - protein, 8 aa, Artificial Sequence
  source: /note="Description of Artificial Sequence: Synthetic peptide"
ISYDDANK

SEQ ID NO: 252 - protein, 16 aa, Artificial Sequence
  source: /note="Description of Artificial Sequence: Synthetic peptide"
GGSGYALHDDYYGQDV

SEQ ID NO: 253 - protein, 16 aa, Artificial Sequence
  source: /note="Description of Artificial Sequence: Synthetic peptide"
GGSGYALHDQYKPVDV

SEQ ID NO: 254 - protein, 16 aa, Artificial Sequence
  source: /note="Description of Artificial Sequence: Synthetic peptide"
GGSGYALHDFQDPTDV

SEQ ID NO: 255 - protein, 16 aa, Artificial Sequence
  source: /note="Description of Artificial Sequence: Synthetic peptide"
GGSGYNLHDDYYGLDV

SEQ ID NO: 256 - protein, 16 aa, Artificial Sequence
  source: /note="Description of Artificial Sequence: Synthetic peptide"
GGSGYEFHEDYYGLDV

SEQ ID NO: 257 - protein, 16 aa, Artificial Sequence
  source: /note="Description of Artificial Sequence: Synthetic peptide"
GGSGYEFQGDYYGLDV

SEQ ID NO: 258 - protein, 16 aa, Artificial Sequence
  source: /note="Description of Artificial Sequence: Synthetic peptide"
GGSGYELRDDYYGLDV

SEQ ID NO: 259 - protein, 16 aa, Artificial Sequence
  source: /note="Description of Artificial Sequence: Synthetic peptide"
GGSGYEVDQDYYGLDV

SEQ ID NO: 260 - protein, 16 aa, Artificial Sequence
  source: /note="Description of Artificial Sequence: Synthetic peptide"
GGSGYAYDGDYYGLDV

SEQ ID NO: 261 - protein, 10 aa, Artificial Sequence
  source: /note="Description of Artificial Sequence: Synthetic peptide"
GFTVSSYGMH

SEQ ID NO: 262 - protein, 10 aa, Artificial Sequence
  source: /note="Description of Artificial Sequence: Synthetic peptide"
GFTFSSYGMH

SEQ ID NO: 263 - protein, 10 aa, Artificial Sequence
  source: /note="Description of Artificial Sequence: Synthetic peptide"
GFTLSSYGMH

SEQ ID NO: 264 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSSPLTFGQGTKVEIK

SEQ ID NO: 265 - protein, 107 aa, Artificial Sequence [sequence omitted]

SEQ ID NO: 266 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYGSPPTFGQGTKVEIK

SEQ ID NO: 267 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYDSPLTFGQGTKVEIK

SEQ ID NO: 268 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYYSPLTFGQGTKVEIK

SEQ ID NO: 269 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYYAPLTFGQGTKVEIK

SEQ ID NO: 270 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYASPLTFGQGTKVEIK

SEQ ID NO: 271 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYGSPLTFGQGTKVEIK

SEQ ID NO: 272 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYDAPLTFGQGTKVEIK

SEQ ID NO: 273 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRLRGVSNRFSGSKSGNTASLTISGLQAEDEADYYCSSYTSSSALYVFGSGTKVTVL

SEQ ID NO: 274 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGSGTKVTVL

SEQ ID NO: 275 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLSGVSNRFSGSKFGNTASLTISGLQAEDEADYYCSSYTSSSTLYVFGSGTKVTVL

SEQ ID NO: 276 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLRGVSNRFSGSKFGNTASLTISGLQAEDEADYYCSSYTSSSALYVFGSGTKVTVL

SEQ ID NO: 277 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLRGVSNRFSGSKFGNTASLTISGLQAEDEADYYCSSYTSSSTLYVFGSGTKVTVL

SEQ ID NO: 278 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPWGVSNRFSGSKFGNTASLTISGLQAEDEADYYCSSYTSSSALYVFGSGTKVTVM

SEQ ID NO: 279 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRLSGVSNRFSGSKFGNTASLTISGLQAEDEADYYCSSYTSSSTLYVFGSGTKVTVL

SEQ ID NO: 280 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPWGVSNRFSGSKFGNTASLTISGLQAEDEADYYCSSYTSSSTLYVFGSGTKVTVL

SEQ ID NO: 281 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRLRGVSNRFSGSKFGNTASLTISGLQAEDEADYYCSSYTSSSALYVFGSGTKVTVL

SEQ ID NO: 282 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRAWGVSNRFSGSKFGNTASLTISGLQAEDEADYYCSSYTSSSALYVFGSGTKVTVL

SEQ ID NO: 283 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLRGVSNRFSGSKFGNTASLTISGLQAEDEAYYYCSSYTSSSTLYVFGSGTKVTVL

SEQ ID NO: 284 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLSGVSNRFSGSKFGNTASLTISGLQAEDEADYYCSSYTSSSALYVFGSGTKVTVL

SEQ ID NO: 285 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRLGGVSNRFSGSKFGNTASLTISGLQAEDEADYYCSSYTSSSALYVFGSGTKVTVL

SEQ ID NO: 286 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARREWWYDDWYLDYWGQGTLVTVSS

SEQ ID NO: 287 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISESGGRAAYADSVKGRFTISRDNSKNTLYLQMNSLRAEDTAVYYCARREWWYDDWYLDYWGQGTLVTVSS

SEQ ID NO: 288 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGRAAYADSVKGRFTISRDNSKNTLYLQMNSLRAEDTAVYYCARREWWYDDWYLDYWGQGTLVTVSS

SEQ ID NO: 289 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISESGDVEAYADSVKGRFTISRDNSKNTLYLQMNSLRAEDTAVYYCARREWWYDDWYLDYWGQGTLVTVSS

SEQ ID NO: 290 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISEAGETTSYADSVKGRFTISRDNSKNTLYLQMNSLRAEDTAVYYCARREWWYDDWYLDYWGQGTLVTVSS

SEQ ID NO: 291 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISEHGHYTSYADSVKGRFTISRDNSKNTLYLQMNSLRAEDTAVYYCARREWWYDDWYLDYWGQGTLVTVSS

SEQ ID NO: 292 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGHTAAYADSVKGRFTISRDNSKNTLYLQMNSLRAEDTAVYYCARREWWYDDWYLDYWGQGTLVTVSS

SEQ ID NO: 293 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGRTHAYADSVKGRFTISRDNSKNTLYLQMNSLRAEDTAVYYCARREWWYDDWYLDYWGQGTLVTVSS

SEQ ID NO: 294 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISAEGGVRAYADSVKGRFTISRDNSKNTLYLQMNSLRAEDTAVYYCARREWWYDDWYLDYWGQGTLVTVSS

SEQ ID NO: 295 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGTTAYADSVKGRFTISRDNSKNTLYLQMNSLRAEDTAVYYCARREWWYDDWYLDYWGQGTLVTVSS

SEQ ID NO: 296 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGATTAYADSVKGRFTISRDNSKNTLYLQMNSLRAEDTAVYYCARREWWYDDWYLDYWGQGTLVTVSS

SEQ ID NO: 297 - protein, 123 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSS

SEQ ID NO: 298 - protein, 123 aa, Artificial Sequence
  source: /note="Description of Artificial Sequence: Synthetic polypeptide"
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCGGSGYALHDDYYGLDVWGQGTLVTVSS

SEQ ID NO: 299 - protein, 124 aa, Artificial Sequence
  source: /note="Description of Artificial Sequence: Synthetic polypeptide"
QAQLQSSEGGVVQPGRSLRLSCAASGFTFSSYGMHWVRQAPGKGLEWVAVISYHGSNKYYADSVKGRFTISRDNSKNTLYLQMNSLRAEDTAVYYCGGSGYALHDDYYGLDVWGQGTLVTVSSS

SEQ ID NO: 300 - protein, 123 aa, Artificial Sequence
  source: /note="Description of Artificial Sequence: Synthetic polypeptide"
QVQLQSSEGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSS

SEQ ID NO: 301 - protein, 123 aa, Artificial Sequence
  source: /note="Description of Artificial Sequence: Synthetic polypeptide"
QAQLQSSGGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSS

SEQ ID NO: 302 - protein, 123 aa, Artificial Sequence
  source: /note="Description of Artificial Sequence: Synthetic polypeptide"
QVQLQDSEGGVVQPGRSLRLSCAASGFTFSSYGMHWVRQAPGKGLEWVAVISYTGTKKYYADSVKGRFTISRDNSKNTLYLQMNSLRAEDTAVYYCGGSGYALHDDYYGLDVWGQGTLVTVSS

SEQ ID NO: 303 - protein, 123 aa, Artificial Sequence
  source: /note="Description of Artificial Sequence: Synthetic polypeptide"
QAQLQSSEGGVVQPGRSLRLSCAASGFTFSSYGMHWVRQAPGKGLEWVAVISYRGFNKYYADSVKGRFTISRDNSKNTLYLQMNSLRAEDTAVYYCGGSGYALHDDYYGQDVWGQGTLVTVSS

SEQ ID NO: 304 - protein, 123 aa, Artificial Sequence
  source: /note="Description of Artificial Sequence: Synthetic polypeptide"
QAQLQGSGGGVVQPGRSLRLSCAASGFTFSSYGMHWVRQAPGKGLEWVAVISYKGSHKYYADSVKGRFTISRDNSKNTLYLQMNSLRAEDTAVYYCGGSGYALHDDYYGLDVWGQGTLVTVSS

SEQ ID NO: 305 - protein, 123 aa, Artificial Sequence
  source: /note="Description of Artificial Sequence: Synthetic polypeptide"
QAQLQSSGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSS

SEQ ID NO: 306 - protein, 123 aa, Artificial Sequence
  source: /note="Description of Artificial Sequence: Synthetic polypeptide"
QVQLQSSGGGVVQPGRSLRLSCAASGFTFSSYGMHWVRQAPGKGLEWVAVISYTGSNKYYADSVKGRFTISRDNSKNTLYLQMNSLRAEDTAVYYCGGSGYALHDDYYGLDVWGQGTLVTVSS

SEQ ID NO: 307 - protein, 123 aa, Artificial Sequence
  source: /note="Description of Artificial Sequence: Synthetic polypeptide"
QAQLQGSGGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSS

SEQ ID NO: 308 - protein, 123 aa, Artificial Sequence
  source: /note="Description of Artificial Sequence: Synthetic polypeptide"
QVQLQGSGGGVVQPGRSLRLSCAASGFTFSSYGMHWVRQAPGKGLEWVAVISYDDAHKYYADSVKGRFTISRDNSKNTLYLQMNSLRAEDTAVYYCGGSGYALHDQYKPVDVWGQGTLVTVSS

SEQ ID NO: 309 - protein, 123 aa, Artificial Sequence
  source: /note="Description of Artificial Sequence: Synthetic polypeptide"
QAQLQESEGGVVQPGGSLRLSCAASGFTFSSYGMHWVRQAPGKGLEWVAVISYNDLNKYYADSVKGRFTISRDNSKNTLYLQMNSLRAEDTAVYYCGGSGYALHDFQDPTDVWGQGTLVTVSS

SEQ ID NO: 310 - protein, 123 aa, Artificial Sequence
  source: /note="Description of Artificial Sequence: Synthetic polypeptide"
QVQLQSSGGGVVQPGRSLRLSCAASGFTVSSYGMHWVRQAPGKGLEWVAVISYSGSNKYYADSVKGRFTISRDNSKNTLYLQMNSLRAEDTAVYYCGGSGYALHDQYKPVDVWGQGTLVTVSS

SEQ ID NO: 311 - protein, 123 aa, Artificial Sequence
  source: /note="Description of Artificial Sequence: Synthetic polypeptide"
QVQLQGSGGGVVQPGRSLRLSCAASGFTFSSYGMHWVRQAPGKGLEWVAVISYTGANKYYADSVKGRFTISRDNSKNTLYLQMNSLRAEDTAVYYCGGSGYNLHDDYYGLDVWGQGTLVTVSS

SEQ ID NO: 312 - protein, 123 aa, Artificial Sequence
  source: /note="Description of Artificial Sequence: Synthetic polypeptide"
QAQLQRSGGGVVQPGRSLRLSCAASGFTFSSYGMHWVRQAPGKGLEWVAVISYDDAHKYYADSVKGRFTISRDNSKNTLYLQMNSLRAEDTAVYYCGGSGYALHDQYKPVDVWGQGTLVTVSS

SEQ ID NO: 313 - protein, 123 aa, Artificial Sequence
  source: /note="Description of Artificial Sequence: Synthetic polypeptide"
QVQLQSSEGGVVQPGRSLRLSCAASGFTLSSYGMHWVRQAPGKGLEWVAVISYTGSNKYYADSVKGRFTISRDNSKNTLYLQMNSLRAEDTAVYYCGGSGYEFHEDYYGLDVWGQGTLVTVSS

SEQ ID NO: 314 - protein, 123 aa, Artificial Sequence
  source: /note="Description of Artificial Sequence: Synthetic polypeptide"
QAQLQGSEGGVVQPGRSLRLSCAASGFTFSSYGMHWVRQAPGKGLEWVAVISYDDAHKYYADSVKGRFTISRDNSKNTLYLQMNSLRAEDTAVYYCGGSGYALHDQYKPVDVWGQGTLVTVSS

SEQ ID NO: 315 - protein, 123 aa, Artificial Sequence
  source: /note="Description of Artificial Sequence: Synthetic polypeptide"
QVQLQSSGGGVVQPGRSLRLSCAASGFTFSSYGMHWVRQAPGKGLEWVAVISYNDLNKYYADSVKGRFTISRDNSKNTLYLQMNSLRAEDTAVYYCGGSGYEFQGDYYGLDVWGQGTLVTVSS

SEQ ID NO: 316 - protein, 123 aa, Artificial Sequence
  source: /note="Description of Artificial Sequence: Synthetic polypeptide"
QVQLQSSEGGVVQPGRSLRLSCAASGFTFSSYGMHWVRQAPGKGLEWVAVISYNDANKYYADSVKGRFTISRDNSKNTLYLQMNSLRAEDTAVYYCGGSGYELRDDYYGLDVWGQGTLVTVSS

SEQ ID NO: 317 - protein, 123 aa, Artificial Sequence
  source: /note="Description of Artificial Sequence: Synthetic polypeptide"
QAQLQSSEGGVVQPGRSLRLSCAASGFTFSSYGMHWVRQAPGKGLEWVAVISYDESNKYYADSVKGRFTISRDNSKNTLYLQMNSLRAEDTAVYYCGGSGYEVDQDYYGLDVWGQGTLVTVSS

SEQ ID NO: 318 - protein, 123 aa, Artificial Sequence
  source: /note="Description of Artificial Sequence: Synthetic polypeptide"
QVQLQESGGGVVQPGRSLRLSCAASGFTFSSYGMHWVRQAPGKGLEWVAVISYDDAHKYYADSVKGRFTISRDNSKNTLYLQMNSLRAEDTAVYYCGGSGYALHDQYKPVDVWGQGTLVTVSS

SEQ ID NO: 319 - protein, 123 aa, Artificial Sequence
  source: /note="Description of Artificial Sequence: Synthetic polypeptide"
QVQLQGSGGGVVQPGRSLRLSCAASGFTVSSYGMHWVRQAPGKGLEWVAVISYDDANKYYADSVKGRFTISRDSSKNTLYLQMNSLRAEDTAVYYCGGSGYAYDGDYYGLDVWGQGTLVTVSS

SEQ ID NO: 320 - protein, 255 aa, Artificial Sequence
  source: /note="Description of Artificial Sequence: Synthetic polypeptide"
QVQLQSSEGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYEVSNRLRGVSNRFSGSKFGNTASLTISGLQAEDEADYYCSSYTSSSALYVFGSGTKVTVL

SEQ ID NO: 321 - protein, 255 aa, Artificial Sequence
  source: /note="Description of Artificial Sequence: Synthetic polypeptide"
QAQLQSSGGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYEVSNRLRGVSNRFSGSKFGNTASLTISGLQAEDEADYYCSSYTSSSTLYVFGSGTKVTVL

SEQ ID NO: 322 - protein, 255 aa, Artificial Sequence
  source: /note="Description of Artificial Sequence: Synthetic polypeptide"
QVQLQDSEGGVVQPGRSLRLSCAASGFTFSSYGMHWVRQAPGKGLEWVAVISYTGTKKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYDVSNRPWGVSNRFSGSKFGNTASLTISGLQAEDEADYYCSSYTSSSALYVFGSGTKVTVM

SEQ ID NO: 323 - protein, 255 aa, Artificial Sequence
  source: /note="Description of Artificial Sequence: Synthetic polypeptide"
QAQLQSSEGGVVQPGRSLRLSCAASGFTFSSYGMHWVRQAPGKGLEWVAVISYRGFNKYYADSVKGRFTISRDNSKNTLYLQMNSLRAEDTAVYYCGGSGYALHDDYYGQDVWGQGTLVTVSSSGGGGSGGGGSGGGGSGGGGSQSALTQPASVSGSPGQSITISCTGTSSDVGGYNYVSWYQQHPGKAPKLMIYDVSNRLSGVSNRFSGSKFGNTASLTISGLQAEDEADYYCSSYTSSSTLYVFGSGTKVTVL

SEQ ID NO: 324 - protein, 255 aa, Artificial Sequence
  source: /note="Description of Artificial Sequence: Synthetic polypeptide"
QAQLQGSGGGVVQPGRSLRLSCAASGFTFSSYGMHWVRQAPGKGLEWVAVISYKGSHKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYDVSNRPWGVSNRFSGSKFGNTASLTISGLQAEDEADYYCSSYTSSSTLYVFGSGTKVTVL

SEQ ID NO: 325 - protein, 255 aa, Artificial Sequence
  source: /note="Description of Artificial Sequence: Synthetic polypeptide"
QVQLQSSEGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYDVSNRPWGVSNRFSGSKFGNTASLTISGLQAEDEADYYCSSYTSSSTLYVFGSGTKVTVL

SEQ ID NO: 326 - protein, 255 aa, Artificial Sequence
  source: /note="Description of Artificial Sequence: Synthetic polypeptide"
QAQLQSSGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYDVSNRLRGVSNRFSGSKFGNTASLTISGLQAEDEADYYCSSYTSSSALYVFGSGTKVTVL

SEQ ID NO: 327 - protein, 255 aa, Artificial Sequence
  source: /note="Description of Artificial Sequence: Synthetic polypeptide"
QVQLQSSGGGVVQPGRSLRLSCAASGFTFSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYDVSNRAWGVSNRFSGSKFGNTASLTISGLQAEDEADYYCSSYTSSSALYVFGSGTKVTVL

SEQ ID NO: 328 - protein, 255 aa, Artificial Sequence
  source: /note="Description of Artificial Sequence: Synthetic polypeptide"
QAQLQGSGGGVVQPGRSLRLSCAASGFTFSSYGMHWVRQAPGKGLEWVAVISYKGSNKYYADSVKGRFTISRDNSKNTLYLQMNSLRAEDTAVYYCGGSGYALHDDYYGLDVWGQGTLVTVSSSGGGGSGGGGSGGGGSGGGGSQSALTQPASVSGSPGQSITISCTGTSSDVGGYNYVSWYQQHPGKAPKLMIYEVSNRLRGVSNRFSGSKFGNTASLTISGLQAEDEADYYCSSYTSSSTLYVFGSGTKVTVL

SEQ ID NO: 329 - protein, 119 aa, Artificial Sequence [sequence omitted]

SEQ ID NO: 330 - protein, 106 aa, Artificial Sequence [sequence omitted]

SEQ ID NO: 331 - protein, 125 aa, Artificial Sequence
  source: /note="Description of Artificial Sequence: Synthetic polypeptide"
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 332 - protein, 109 aa, Artificial Sequence
  source: /note="Description of Artificial Sequence: Synthetic polypeptide"
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 333 - protein, 119 aa, Artificial Sequence
  source: /note="Description of Artificial Sequence: Synthetic polypeptide"
QVQLQQSGAELARPGASVKMSCKASGYTFTSYTMHWVKQRPGQGLEWIGYINPSSGYTKYNQKFKDKATLTADKSSSTAYMQLSSLTSEDSAVYYCARWQDYDVYFDYWGQGTTLTVSS

SEQ ID NO: 334 - protein, 106 aa, Artificial Sequence
  source: /note="Description of Artificial Sequence: Synthetic polypeptide"
QIVLSQSPAILSASPGEKVTMTCRASSSVSYMHWYQQKPGSSPKPWIYATSNLASGVPARFSGSGSGTSYSLTISRVEAEDAATYYCQQWSSNPPTFGGGTKLETK

SEQ ID NO: 335 - protein, 106 aa, Artificial Sequence
  source: /note="Description of Artificial Sequence: Synthetic polypeptide"
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEIN

SEQ ID NO: 336 - protein, 119 aa, Artificial Sequence [sequence omitted]

SEQ ID NO: 337 - protein, 106 aa, Artificial Sequence [sequence omitted]

SEQ ID NO: 338 - protein, 118 aa, Artificial Sequence [sequence omitted]

SEQ ID NO: 339 - protein, 108 aa, Artificial Sequence [sequence omitted]

SEQ ID NO: 340 - protein, 124 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKDRFISRDDSKNSLYLQMNSLKTEDTAVYYCVRHGNFGNSYVSWFAYWGQGTLVTVSS

SEQ ID NO: 341 - protein, 107 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPWTPARFSGSLLGGKAALIGAQAEDEADYYCALWYSNLWVFGGGTKLTVL

SEQ ID NO: 342 - protein, 119 aa, Artificial Sequence
  source: /note="Description of Artificial Sequence: Synthetic polypeptide"
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 343 - protein, 105 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLISSMEAEDAATYYCQQWSSNPLTFGAGTKLELK

SEQ ID NO: 344 - protein, 124 aa, Artificial Sequence
  source: /note="Description of Artificial Sequence: Synthetic polypeptide"
EVQLVESGGGLVQPGGSLRLSCAASGFTFNTYAMNWVRQAPGKGLEWVARIRSKYNNYATYYADSVKDRFISRDDSKNSLYLQMNSLKTEDTAVYYCVRHGNFGNSYVSWFAYWGQGTLVTVSS

SEQ ID NO: 345 - protein, 125 aa, Artificial Sequence
  source: /note="Description of Artificial Sequence: Synthetic polypeptide"
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 346 - protein, 125 aa, Artificial Sequence
  source: /note="Description of Artificial Sequence: Synthetic polypeptide"
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 347 - protein, 109 aa, Artificial Sequence
  source: /note="Description of Artificial Sequence: Synthetic polypeptide"
QTVVTQEPSLTVSPGGTVTLTCGSSTGAVTSGNYPNWVQQKPGQAPRGLIGGTKFLAPGTPQRFSGSLLGGKAALTLSGVQPEDEAEYYCVLWYSNRWVFGGGTKLTVL

SEQ ID NO: 348 - protein, 125 aa, Artificial Sequence
  source: /note="Description of Artificial Sequence: Synthetic polypeptide"
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 349 - protein, 109 aa, Artificial Sequence
  source: /note="Description of Artificial Sequence: Synthetic polypeptide"
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 350 - protein, 254 aa, Artificial Sequence
  source: /note="Description of Artificial Sequence: Synthetic polypeptide"
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 351 - protein, 119 aa, Artificial Sequence
  source: /note="Description of Artificial Sequence: Synthetic polypeptide"
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYCLDYWGQGTLVTVSS

SEQ ID NO: 352 - protein, 106 aa, Artificial Sequence
  source: /note="Description of Artificial Sequence: Synthetic polypeptide"
EIVLTQSPATLSLSPGERATLSCSASSSVSYMNWYQQKPGQAPRLLIYDTSKLASGVPAHFRGSGSGTDFTLTISSLEPEDFAVYYCQQWSSNPFTFGQGTKVEIK

SEQ ID NO: 353 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVSRIRSKYNNYATYYADSVKDRFTISRDDSKNTLYLQMNSLRAEDTAVYYCARHGNFGNSYVSWFAYWGQGTMVTVSS

SEQ ID NO: 354 - protein, 109 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 355 - protein, 125 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 356 - protein, 109 aa, Artificial Sequence
  source: /note="Description of Artificial Sequence: Synthetic polypeptide"
QAVVTQEPSLTVSPGGTVTLTCRSSTGAVTTSNYANWVQEKPGQAPRGLIGGTNKRAPWTPARFSGSLLGGKAALTITGAQAEDEADYYCALWYSNLWVFGGGTKLTVL

SEQ ID NO: 357 - protein, 125 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 358 - protein, 109 aa, Artificial Sequence
  source: /note="Description of Artificial Sequence: Synthetic polypeptide"
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 359 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 360 - protein, 109 aa, Artificial Sequence
  source: /note="Description of Artificial Sequence: Synthetic polypeptide"
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 361 - protein, 101 aa, Artificial Sequence
  source: /note="Description of Artificial Sequence: Synthetic polypeptide"
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGT

SEQ ID NO: 362 - protein, 119 aa, Artificial Sequence
  source: /note="Description of Artificial Sequence: Synthetic polypeptide"
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYSLDYWGQGTPVTVSS

SEQ ID NO: 363 - protein, 122 aa, Artificial Sequence
  source: /note="Description of Artificial Sequence: Synthetic polypeptide"
EVQLQQSGPELVKPGASMKISCKASGYSFTGYTMNWVKQSHGKNLEWMGLINPYKGVSTYNQKFKDKATLTVDKSSSTAYMELLSLTSEDSAVYYCARSGYYGDSDWYFDVWGQGTTLTVFS

SEQ ID NO: 364 - protein, 107 aa, Artificial Sequence
  source: /note="Description of Artificial Sequence: Synthetic polypeptide"
DIQMTQTTSSLSASLGDRVTISCRASQDIRNYLNWYQQKPDGTVKLLIYYTSRLHSGVPSKFSGSGSGTDYSLTISNLEQEDIATYFCQQGNTLPWTFAGGTKLEIK

SEQ ID NO: 365 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSS

SEQ ID NO: 366 - protein, 109 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 367 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 368 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 369 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 370 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 371 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 372 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 373 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 374 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 375 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 376 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 377 - protein, 125 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 378 - protein, 254 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 379 - protein, 257 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 380 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSS

SEQ ID NO: 381 - protein, 109 aa, Artificial Sequence
  source: /note="Description of Artificial Sequence: Synthetic polypeptide"
QAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL

SEQ ID NO: 382 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSSGGGGSGGGGSGGGGSGGGGSQAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL

SEQ ID NO: 383 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSS

SEQ ID NO: 384 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 385 - protein, 5 aa, Artificial Sequence
  source: /note="Description of Artificial Sequence: Synthetic peptide"
RYTMH

SEQ ID NO: 386 - protein, 10 aa, Artificial Sequence
  source: /note="Description of Artificial Sequence: Synthetic peptide"
SASSSVSYMN

SEQ ID NO: 387 - protein, 5 aa, Artificial Sequence
  source: /note="Description of Artificial Sequence: Synthetic peptide"
TYAMN

SEQ ID NO: 388 - protein, 14 aa, Artificial Sequence
  source: /note="Description of Artificial Sequence: Synthetic peptide"
RSSTGAVTTSNYAN

SEQ ID NO: 389 - protein, 5 aa, Artificial Sequence
  source: /note="Description of Artificial Sequence: Synthetic peptide"
SYTMH

SEQ ID NO: 390 - protein, 10 aa, Artificial Sequence
  source: /note="Description of Artificial Sequence: Synthetic peptide"
RASSSVSYMH

SEQ ID NO: 391 - protein, 10 aa, Artificial Sequence
  source: /note="Description of Artificial Sequence: Synthetic peptide"
RASSSVSYMN

SEQ ID NO: 392 - protein, 5 aa, Artificial Sequence
  source: /note="Description of Artificial Sequence: Synthetic peptide"
GYGMH

SEQ ID NO: 393 - protein, 11 aa, Artificial Sequence
  source: /note="Description of Artificial Sequence: Synthetic peptide"
RASQSVSSYLA

SEQ ID NO: 394 - protein, 5 aa, Artificial Sequence
  source: /note="Description of Artificial Sequence: Synthetic peptide"
SYAMN

SEQ ID NO: 395 - protein, 14 aa, Artificial Sequence
  source: /note="Description of Artificial Sequence: Synthetic peptide"
GSSTGAVTSGNYPN

SEQ ID NO: 396 - protein, 5 aa, Artificial Sequence
  source: /note="Description of Artificial Sequence: Synthetic peptide"
KYAMN

SEQ ID NO: 397 - protein, 14 aa, Artificial Sequence
  source: /note="Description of Artificial Sequence: Synthetic peptide"
GSSTGAVTTSNYAN

SEQ ID NO: 398 - protein, 5 aa, Artificial Sequence
  source: /note="Description of Artificial Sequence: Synthetic peptide"
GYTMN

SEQ ID NO: 399 - protein, 11 aa, Artificial Sequence
  source: /note="Description of Artificial Sequence: Synthetic peptide"
RASQDIRNYLN

SEQ ID NO: 400 - protein, 5 aa, Artificial Sequence
  source: /note="Description of Artificial Sequence: Synthetic peptide"
TYAMS

SEQ ID NO: 401 - protein, 5 aa, Artificial Sequence
  source: /note="Description of Artificial Sequence: Synthetic peptide"
TYAMH

SEQ ID NO: 402 - protein, 14 aa, Artificial Sequence
  source: /note="Description of Artificial Sequence: Synthetic peptide"
GSSTGAVTSSNYAN

SEQ ID NO: 403 - protein, 14 aa, Artificial Sequence
  source: /note="Description of Artificial Sequence: Synthetic peptide"
GSSTGAVTSGHYAN

SEQ ID NO: 404 - protein, 14 aa, Artificial Sequence
  source: /note="Description of Artificial Sequence: Synthetic peptide"
KSSTGAVTTSNYAN

SEQ ID NO: 405 - protein, 17 aa, Artificial Sequence
  source: /note="Description of Artificial Sequence: Synthetic peptide"
YINPSRGYTNYNQKFKD

SEQ ID NO: 406 - protein, 7 aa, Artificial Sequence
  source: /note="Description of Artificial Sequence: Synthetic peptide"
DTSKLAS

SEQ ID NO: 407 - protein, 19 aa, Artificial Sequence
  source: /note="Description of Artificial Sequence: Synthetic peptide"
RIRSKYNNYATYYADSVKD

SEQ ID NO: 408 - protein, 7 aa, Artificial Sequence
  source: /note="Description of Artificial Sequence: Synthetic peptide"
GTNKRAP

SEQ ID NO: 409 - protein, 17 aa, Artificial Sequence
  source: /note="Description of Artificial Sequence: Synthetic peptide"
YINPSSGYTKYNQKFKD

SEQ ID NO: 410 - protein, 7 aa, Artificial Sequence
  source: /note="Description of Artificial Sequence: Synthetic peptide"
ATSNLAS

SEQ ID NO: 411 - protein, 7 aa, Artificial Sequence
  source: /note="Description of Artificial Sequence: Synthetic peptide"
DTSKVAS

SEQ ID NO: 412 - protein, 17 aa, Artificial Sequence
  source: /note="Description of Artificial Sequence: Synthetic peptide"
YINPSRGYTNYNQKVKD

SEQ ID NO: 413 - protein, 17 aa, Artificial Sequence
  source: /note="Description of Artificial Sequence: Synthetic peptide"
VIWYDGSKKYYVDSVKG

SEQ ID NO: 414 - protein, 7 aa, Artificial Sequence
  source: /note="Description of Artificial Sequence: Synthetic peptide"
DASNRAT

SEQ ID NO: 415 - protein, 15 aa, Artificial Sequence
  source: /note="Description of Artificial Sequence: Synthetic peptide"
RIRSKYNNYATYYAD

SEQ ID NO: 416 - protein, 19 aa, Artificial Sequence
  source: /note="Description of Artificial Sequence: Synthetic peptide"
RIRSKYNNYATYYADSVKG

SEQ ID NO: 417 - protein, 7 aa, Artificial Sequence
  source: /note="Description of Artificial Sequence: Synthetic peptide"
GTKFLAP

SEQ ID NO: 418 - protein, 17 aa, Artificial Sequence
  source: /note="Description of Artificial Sequence: Synthetic peptide"
LINPYKGVSTYNQKFKD

SEQ ID NO: 419 - protein, 6 aa, Artificial Sequence
  source: /note="Description of Artificial Sequence: Synthetic peptide"
YTSRLH

SEQ ID NO: 420 - protein, 19 aa, Artificial Sequence
  source: /note="Description of Artificial Sequence: Synthetic peptide"
RIRSKANNYATYYADSVKG

SEQ ID NO: 421 - protein, 20 aa, Artificial Sequence
  source: /note="Description of Artificial Sequence: Synthetic peptide"
RIRSKANNYYATYYADSVKG

SEQ ID NO: 422 - protein, 19 aa, Artificial Sequence
  source: /note="Description of Artificial Sequence: Synthetic peptide"
RIRSKANSYATYYADSVKG

SEQ ID NO: 423 - protein, 19 aa, Artificial Sequence
  source: /note="Description of Artificial Sequence: Synthetic peptide"
RIRSKYNNYATAYADSVKG

SEQ ID NO: 424 - protein, 7 aa, Artificial Sequence
  source: /note="Description of Artificial Sequence: Synthetic peptide"
DTNKRAP

SEQ ID NO: 425 - protein, 7 aa, Artificial Sequence
  source: /note="Description of Artificial Sequence: Synthetic peptide"
GTNNRAP

SEQ ID NO: 426 - protein, 7 aa, Artificial Sequence
  source: /note="Description of Artificial Sequence: Synthetic peptide"
GTNKRAS

SEQ ID NO: 427 - protein, 7 aa, Artificial Sequence
  source: /note="Description of Artificial Sequence: Synthetic peptide"
GTSNKHS

SEQ ID NO: 428 - protein, 18 aa, Artificial Sequence
  source: /note="Description of Artificial Sequence: Synthetic peptide"
RIRSNGGYSTYYADSVKG

SEQ ID NO: 429 - protein, 10 aa, Artificial Sequence
  source: /note="Description of Artificial Sequence: Synthetic peptide"
YYDDHYCLDY

SEQ ID NO: 430 - protein, 9 aa, Artificial Sequence
  source: /note="Description of Artificial Sequence: Synthetic peptide"
QQWSSNPFT

SEQ ID NO: 431 - protein, 14 aa, Artificial Sequence
  source: /note="Description of Artificial Sequence: Synthetic peptide"
HGNFGNSYVSWFAY

SEQ ID NO: 432 - protein, 9 aa, Artificial Sequence
  source: /note="Description of Artificial Sequence: Synthetic peptide"
ALWYSNLWV

SEQ ID NO: 433 - protein, 10 aa, Artificial Sequence
  source: /note="Description of Artificial Sequence: Synthetic peptide"
WQDYDVYFDY

SEQ ID NO: 434 - protein, 9 aa, Artificial Sequence
  source: /note="Description of Artificial Sequence: Synthetic peptide"
QQWSSNPPT

SEQ ID NO: 435 - protein, 9 aa, Artificial Sequence
  source: /note="Description of Artificial Sequence: Synthetic peptide"
QQWSSNPLT

SEQ ID NO: 436 - protein, 9 aa, Artificial Sequence
  source: /note="Description of Artificial Sequence: Synthetic peptide"
QMGYWHFDL

SEQ ID NO: 437 - protein, 10 aa, Artificial Sequence
  source: /note="Description of Artificial Sequence: Synthetic peptide"
QQRSNWPPLT

SEQ ID NO: 438 - protein, 16 aa, Artificial Sequence
  source: /note="Description of Artificial Sequence: Synthetic peptide"
VRHGNFGNSYVSWFAY

SEQ ID NO: 439 - protein, 14 aa, Artificial Sequence
  source: /note="Description of Artificial Sequence: Synthetic peptide"
HGNFGNSYVSWWAY

SEQ ID NO: 440 - protein, 9 aa, Artificial Sequence
  source: /note="Description of Artificial Sequence: Synthetic peptide"
VLWYSNRWV

SEQ ID NO: 441 - protein, 14 aa, Artificial Sequence
  source: /note="Description of Artificial Sequence: Synthetic peptide"
HGNFGNSYISYWAY

SEQ ID NO: 442 - protein, 14 aa, Artificial Sequence
  source: /note="Description of Artificial Sequence: Synthetic peptide"
HGNFGDSYVSWFAY

SEQ ID NO: 443 - protein, 9 aa, Artificial Sequence
  source: /note="Description of Artificial Sequence: Synthetic peptide"
ALWYSNHWV

SEQ ID NO: 444 - protein, 10 aa, Artificial Sequence
  source: /note="Description of Artificial Sequence: Synthetic peptide"
YYDDHYSLDY

SEQ ID NO: 445 - protein, 13 aa, Artificial Sequence
  source: /note="Description of Artificial Sequence: Synthetic peptide"
SGYYGDSDWYFDV

SEQ ID NO: 446 - protein, 9 aa, Artificial Sequence
  source: /note="Description of Artificial Sequence: Synthetic peptide"
QQGNTLPWT

SEQ ID NO: 447 - protein, 14 aa, Artificial Sequence
  source: /note="Description of Artificial Sequence: Synthetic peptide"
HGNFGDEYVSWFAY

SEQ ID NO: 448 - protein, 14 aa, Artificial Sequence
  source: /note="Description of Artificial Sequence: Synthetic peptide"
HGNFGDPYVSWFAY

SEQ ID NO: 449 - protein, 14 aa, Artificial Sequence
  source: /note="Description of Artificial Sequence: Synthetic peptide"
HGNFGDSYVSWFDY

SEQ ID NO: 450 - protein, 14 aa, Artificial Sequence
  source: /note="Description of Artificial Sequence: Synthetic peptide"
HGNFGQSYVSWFAY

SEQ ID NO: 451 - protein, 14 aa, Artificial Sequence
  source: /note="Description of Artificial Sequence: Synthetic peptide"
HGNFGNSYVSWFDY

SEQ ID NO: 452 - protein, 9 aa, Artificial Sequence
  source: /note="Description of Artificial Sequence: Synthetic peptide"
LLWYSNLWV

SEQ ID NO: 453 - protein, 14 aa, Artificial Sequence
  source: /note="Description of Artificial Sequence: Synthetic peptide"
HGNFGNSYVSWFAH

SEQ ID NO: 454 - protein, 7 aa, Artificial Sequence
  source: /note="Description of Artificial Sequence: Synthetic peptide"
GYTFTRY

SEQ ID NO: 455 - protein, 6 aa, Artificial Sequence
  source: /note="Description of Artificial Sequence: Synthetic peptide"
SSSVSY

SEQ ID NO: 456 - protein, 7 aa, Artificial Sequence
  source: /note="Description of Artificial Sequence: Synthetic peptide"
GFTFNTY

SEQ ID NO: 457 - protein, 10 aa, Artificial Sequence
  source: /note="Description of Artificial Sequence: Synthetic peptide"
STGAVTTSNY

SEQ ID NO: 458 - protein, 7 aa, Artificial Sequence
  source: /note="Description of Artificial Sequence: Synthetic peptide"
GYTFTSY

SEQ ID NO: 459 - protein, 7 aa, Artificial Sequence
  source: /note="Description of Artificial Sequence: Synthetic peptide"
GFKFSGY

SEQ ID NO: 460 - protein, 7 aa, Artificial Sequence
  source: /note="Description of Artificial Sequence: Synthetic peptide"
SQSVSSY

SEQ ID NO: 461 - protein, 7 aa, Artificial Sequence
  source: /note="Description of Artificial Sequence: Synthetic peptide"
GFTFSTY

SEQ ID NO: 462 - protein, 7 aa, Artificial Sequence
  source: /note="Description of Artificial Sequence: Synthetic peptide"
GFTFNSY

SEQ ID NO: 463 - protein, 10 aa, Artificial Sequence
  source: /note="Description of Artificial Sequence: Synthetic peptide"
STGAVTSGNY

SEQ ID NO: 464 - protein, 7 aa, Artificial Sequence
  source: /note="Description of Artificial Sequence: Synthetic peptide"
GFTFNKY

SEQ ID NO: 465 - protein, 7 aa, Artificial Sequence
  source: /note="Description of Artificial Sequence: Synthetic peptide"
GYSFTGY

SEQ ID NO: 466 - protein, 7 aa, Artificial Sequence
  source: /note="Description of Artificial Sequence: Synthetic peptide"
SQDIRNY

SEQ ID NO: 467 - protein, 6 aa, Artificial Sequence
  source: /note="Description of Artificial Sequence: Synthetic peptide"
NPSRGY

SEQ ID NO: 468 - protein, 3 aa, Artificial Sequence
  source: /note="Description of Artificial Sequence: Synthetic peptide"
DTS

SEQ ID NO: 469 - protein, 8 aa, Artificial Sequence
  source: /note="Description of Artificial Sequence: Synthetic peptide"
RSKYNNYA

SEQ ID NO: 470 - protein, 3 aa, Artificial Sequence
  source: /note="Description of Artificial Sequence: Synthetic peptide"
GTN

SEQ ID NO: 471 - protein, 6 aa, Artificial Sequence
  source: /note="Description of Artificial Sequence: Synthetic peptide"
NPSSGY

SEQ ID NO: 472 - protein, 3 aa, Artificial Sequence
  source: /note="Description of Artificial Sequence: Synthetic peptide"
ATS

SEQ ID NO: 473 - protein, 6 aa, Artificial Sequence
  source: /note="Description of Artificial Sequence: Synthetic peptide"
WYDGSK

SEQ ID NO: 474 - protein, 3 aa, Artificial Sequence
  source: /note="Description of Artificial Sequence: Synthetic peptide"
DAS

SEQ ID NO: 475 - protein, 9 aa, Artificial Sequence
  source: /note="Description of Artificial Sequence: Synthetic peptide"
RSKYNNYAT

SEQ ID NO: 476 - protein, 3 aa, Artificial Sequence
  source: /note="Description of Artificial Sequence: Synthetic peptide"
GTK

SEQ ID NO: 477 - protein, 6 aa, Artificial Sequence
  source: /note="Description of Artificial Sequence: Synthetic peptide"
NPYKGV

SEQ ID NO: 478 - protein, 3 aa, Artificial Sequence
  source: /note="Description of Artificial Sequence: Synthetic peptide"
YTS

SEQ ID NO: 479 - protein, 6 aa, Artificial Sequence
  source: /note="Description of Artificial Sequence: Synthetic peptide"
WSSNPF

SEQ ID NO: 480 - protein, 6 aa, Artificial Sequence
  source: /note="Description of Artificial Sequence: Synthetic peptide"
WYSNLW

SEQ ID NO: 481 - protein, 6 aa, Artificial Sequence
  source: /note="Description of Artificial Sequence: Synthetic peptide"
WSSNPP

SEQ ID NO: 482 - protein, 6 aa, Artificial Sequence
  source: /note="Description of Artificial Sequence: Synthetic peptide"
WSSNPL

SEQ ID NO: 483 - protein, 7 aa, Artificial Sequence
  source: /note="Description of Artificial Sequence: Synthetic peptide"
RSNWPPL

SEQ ID NO: 484 - protein, 13 aa, Artificial Sequence
  source: /note="Description of Artificial Sequence: Synthetic peptide"
HGNFGNSYVSWFA

SEQ ID NO: 485 - protein, 6 aa, Artificial Sequence
  source: /note="Description of Artificial Sequence: Synthetic peptide"
WYSNRW

SEQ ID NO: 486 - protein, 6 aa, Artificial Sequence
  source: /note="Description of Artificial Sequence: Synthetic peptide"
WYSNHW

SEQ ID NO: 487 - protein, 6 aa, Artificial Sequence
  source: /note="Description of Artificial Sequence: Synthetic peptide"
GNTLPW

SEQ ID NO: 488 - protein, 10 aa, Artificial Sequence
  source: /note="Description of Artificial Sequence: Synthetic peptide"
GYTFTRYTMH

SEQ ID NO: 489 - protein, 10 aa, Artificial Sequence
  source: /note="Description of Artificial Sequence: Synthetic peptide"
GFTFNTYAMN

SEQ ID NO: 490 - protein, 10 aa, Artificial Sequence
  source: /note="Description of Artificial Sequence: Synthetic peptide"
GYTFTSYTMH

SEQ ID NO: 491 - protein, 10 aa, Artificial Sequence
  source: /note="Description of Artificial Sequence: Synthetic peptide"
GFKFSGYGMH

SEQ ID NO: 492 - protein, 10 aa, Artificial Sequence
  source: /note="Description of Artificial Sequence: Synthetic peptide"
GFTFSTYAMN

SEQ ID NO: 493 - protein, 10 aa, Artificial Sequence
  source: /note="Description of Artificial Sequence: Synthetic peptide"
GFTFNSYAMN

SEQ ID NO: 494 - protein, 10 aa, Artificial Sequence
  source: /note="Description of Artificial Sequence: Synthetic peptide"
GFTFNKYAMN

SEQ ID NO: 495 - protein, 10 aa, Artificial Sequence
  source: /note="Description of Artificial Sequence: Synthetic peptide"
GYSFTGYTMN

SEQ ID NO: 496 - protein, 18 aa, Artificial Sequence
  source: /note="Description of Artificial Sequence: Synthetic peptide"
RIRSKYNNYATYYADSVK

SEQ ID NO: 497 - protein, 7 aa, Artificial Sequence
  source: /note="Description of Artificial Sequence: Synthetic peptide"
YTSRLHS

SEQ ID NO: 498 - protein, 152 aa, Artificial Sequence
  source: /note="Description of Artificial Sequence: Synthetic polypeptide"
MQIFVKTLTGKTITLEVEPSDTIENVKAKIQDKEGIPPDQQWLWFAGKQLEDGRTLSDYNIQKESTLKLWLVDKAAMQIFVYTRTGKTITLEVEPSDTIENVKAKIQDKEGIPPDQQRLIWAGKQLEDGRTLSDYNIALESGLHLVLRLRAA

SEQ ID NO: 499 - protein, 13 aa, Artificial Sequence
  source: /note="Description of Artificial Sequence: Synthetic peptide"
KASGYKFTSYVMH

SEQ ID NO: 500 - protein, 16 aa, Artificial Sequence
  source: /note="Description of Artificial Sequence: Synthetic peptide"
YINPYNDVTKYNEKFK

SEQ ID NO: 501 - protein, 11 aa, Artificial Sequence
  source: /note="Description of Artificial Sequence: Synthetic peptide"
GSYYDYDGFVY

SEQ ID NO: 502 - protein, 10 aa, Artificial Sequence
  source: /note="Description of Artificial Sequence: Synthetic peptide"
SATSSVSYMH

SEQ ID NO: 503 - protein, 120 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSA

SEQ ID NO: 504 - protein, 106 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELK

SEQ ID NO: 505 - protein, 5 aa, Artificial Sequence
  source: /note="Description of Artificial Sequence: Synthetic peptide"
EYYMY

SEQ ID NO: 506 - protein, 17 aa, Artificial Sequence
  source: /note="Description of Artificial Sequence: Synthetic peptide"
RIDPEDGSIDYVEKFKK

SEQ ID NO: 507 - protein, 9 aa, Artificial Sequence
  source: /note="Description of Artificial Sequence: Synthetic peptide"
GKFNYRFAY

SEQ ID NO: 508 - protein, 16 aa, Artificial Sequence
  source: /note="Description of Artificial Sequence: Synthetic peptide"
RSSQSLLHSSGNTYLN

SEQ ID NO: 509 - protein, 7 aa, Artificial Sequence
  source: /note="Description of Artificial Sequence: Synthetic peptide"
LVSKLES

SEQ ID NO: 510 - protein, 8 aa, Artificial Sequence
  source: /note="Description of Artificial Sequence: Synthetic peptide"
QFTHYPYT

SEQ ID NO: 511 - protein, 118 aa, Artificial Sequence
  source: /note="Description of Artificial Sequence: Synthetic polypeptide"
EVQLQQSGPELQRPGASVKLSCKASGYIFTEYYMYWVKQRPKQGLELVGRIDPEDGSIDYVEKFKKKATLTADTSSNTAYMQLSSLTSEDTATYFCARGKFNYRFAYWGQGTLVTVSS

SEQ ID NO: 512 - protein, 112 aa, Artificial Sequence
  source: /note="Description of Artificial Sequence: Synthetic polypeptide"
DVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELK

SEQ ID NO: 513 - protein, 118 aa, Artificial Sequence
  source: /note="Description of Artificial Sequence: Synthetic polypeptide"
QVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSS

SEQ ID NO: 514 - protein, 112 aa, Artificial Sequence
  source: /note="Description of Artificial Sequence: Synthetic polypeptide"
DVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIK

SEQ ID NO: 515 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 516 - protein, 237 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNVL

SEQ ID NO: 517 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 518 - protein, 187 aa, Homo sapiens
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHR

SEQ ID NO: 519 - protein, 187 aa, Artificial Sequence; identical to SEQ ID NO: 518
  source: /note="Description of Artificial Sequence: Synthetic polypeptide"
  VARIANT (1)..(1): /replace="Ser"
  VARIANT (9)..(9): /replace="Lys"
  VARIANT (21)..(21): /replace="Gln"
  VARIANT (58)..(58): /replace="Lys"
  VARIANT (85)..(85): /replace="Ser"
  VARIANT (93)..(93): /replace="Gly"
  SITE (1)..(187): /note="Variant residues given in the sequence have no preference with respect to those in the annotations for variant positions"

SEQ ID NO: 520 - protein, 94 aa, Homo sapiens
SQQIYGVVYGNVTFHVPSNVPLKEVLWKKQKDKVAELENSEFRAFSSFKNRVYLDTVSGSLTIYNLTSSDEDEYEMESPNITDTMKFFLYVLES

SEQ ID NO: 521 - protein, 94 aa, Artificial Sequence; identical to SEQ ID NO: 520
  source: /note="Description of Artificial Sequence: Synthetic polypeptide"
  VARIANT (8)..(8): /replace="Lys"
  VARIANT (20)..(20): /replace="Gln"
  SITE (1)..(94): /note="Variant residues given in the sequence have no preference with respect to those in the annotations for variant positions"

SEQ ID NO: 522 - protein, 94 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLES

SEQ ID NO: 523 - protein, 94 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLES

SEQ ID NO: 524 - protein, 94 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLES

SEQ ID NO: 525 - protein, 94 aa, Artificial Sequence
  source: /note="Description of Artificial Sequence: Synthetic polypeptide"
SQQIYGVVYGNVTFHVPSNVPLKEVLCKKQKDKVAELENSEFRAFSSFKNRVYLDTVSGSCTIYNLTSSDEDEYEMESPNITDTMKFFLYVLES

SEQ ID NO: 526 - protein, 5 aa, Artificial Sequence
  source: /note="Description of Artificial Sequence: Synthetic peptide"
DYGVS

SEQ ID NO: 527 - protein, 16 aa, Artificial Sequence
  source: /note="Description of Artificial Sequence: Synthetic peptide"
VIWGSETTYYNSALKS

SEQ ID NO: 528 - protein, 16 aa, Artificial Sequence
  source: /note="Description of Artificial Sequence: Synthetic peptide"
VIWGSETTYYSSSLKS

SEQ ID NO: 529 - protein, 16 aa, Artificial Sequence
  source: /note="Description of Artificial Sequence: Synthetic peptide"
VIWGSETTYYQSSLKS

SEQ ID NO: 530 - protein, 16 aa, Artificial Sequence
  source: /note="Description of Artificial Sequence: Synthetic peptide"
VIWGSETTYYNSSLKS

SEQ ID NO: 531 - protein, 12 aa, Artificial Sequence
  source: /note="Description of Artificial Sequence: Synthetic peptide"
HYYYGGSYAMDY

SEQ ID NO: 532 - protein, 11 aa, Artificial Sequence
  source: /note="Description of Artificial Sequence: Synthetic peptide"
RASQDISKYLN

SEQ ID NO: 533 - protein, 7 aa, Artificial Sequence
  source: /note="Description of Artificial Sequence: Synthetic peptide"
HTSRLHS

SEQ ID NO: 534 - protein, 9 aa, Artificial Sequence
  source: /note="Description of Artificial Sequence: Synthetic peptide"
QQGNTLPYT

SEQ ID NO: 535 - protein, 120 aa, Artificial Sequence
  source: /note="Description of Artificial Sequence: Synthetic polypeptide"
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 536 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 537 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 538 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 539 - protein, 107 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 540 - protein, 107 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 541 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 542 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 543 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 544 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 545 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 546 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 547 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 548 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 549 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 550 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 551 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 552 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 553 - protein, 4 aa, Artificial Sequence
  source: /note="Description of Artificial Sequence: Synthetic peptide"
GFLG

SEQ ID NO: 554 - protein, 4 aa, Artificial Sequence
  source: /note="Description of Artificial Sequence: Synthetic peptide"
ALAL

SEQ ID NO: 555 - protein, 4 aa, Artificial Sequence
  source: /note="Description of Artificial Sequence: Synthetic peptide"
RGDS

SEQ ID NO: 556 - protein, 487 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSGGGGSGGGGSQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGS

SEQ ID NO: 557 - protein, 217 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRLRGVSNRFSGSKSGNTASLTISGLQAEDEADYYCSSYTSSSALYVFGSGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 558 - protein, 99 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGS

SEQ ID NO: 559 - protein, 335 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGS

SEQ ID NO: 560 - protein, 251 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSGGGGSGGGGSQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGS

SEQ ID NO: 561 - protein, 138 aa, Artificial Sequence
  source: /note="Description of Artificial Sequence: Synthetic polypeptide"
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGS

SEQ ID NO: 562 - protein, 495 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 563 - protein, 259 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 564 - protein, 8 aa, Artificial Sequence
  source: /note="Description of Artificial Sequence: Synthetic 8xHis tag"
HHHHHHHH

SEQ ID NO: 565 - protein, 8 aa, Artificial Sequence
  source: /note="Description of Artificial Sequence: Synthetic peptide"
EVNLYFQS

SEQ ID NO: 566 - protein, 206 aa, Artificial Sequence
  source: /note="Description of Artificial Sequence: Synthetic polypeptide"
SKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDGGGGSGLNDIFEAQKIEWHE

SEQ ID NO: 567 - protein, 206 aa, Artificial Sequence
  source: /note="Description of Artificial Sequence: Synthetic polypeptide"
SKEIRNALETWGALGQDIDLDIPSFQMSDDIDDIRWEKTSDKKKIAQFRKEKETFEEKDAYKLFKNGTLKIKHLKIHDQDSYKVSIYDTKGKNVLEKTFDLKIQERVSEPKISWTCINTTLTCEVMNGTDPELNLYQDGKHVKLSQRVITHKWTTSLSAKFKCTAGNKVSKESRMETVSCPEKGLDGGGGSGLNDIFEAQKIEWHE

SEQ ID NO: 568 - protein, 199 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRGGGGSHHHHHHHH

SEQ ID NO: 569 - protein, 107 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSHHHHHHHH

SEQ ID NO: 570 - protein, 107 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLESGGGGSHHHHHHHH

SEQ ID NO: 571 - protein, 107 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLESGGGGSHHHHHHHH

SEQ ID NO: 572 - protein, 107 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLESGGGGSHHHHHHHH

SEQ ID NO: 573 - protein, 10 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  VARIANT (10)..(10): /replace="Ser"
  SITE (1)..(10): /note="Variant residues given in the sequence have no preference with respect to those in the annotations for variant positions"
GFTFSKNGMH

SEQ ID NO: 574 - protein, 8 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  SITE (1)..(8): /note="Variant residues given in the sequence have no preference with respect to those in the annotations for variant positions"
GFTFSKNG

SEQ ID NO: 575 - protein, 5 aa, Artificial Sequence
  source: /note="Description of Artificial Sequence: Synthetic peptide"
  VARIANT (2)..(2): /replace="Tyr" or "Gln"
  VARIANT (5)..(5): /replace="Ser"
  SITE (1)..(5): /note="Variant residues given in the sequence have no preference with respect to those in the annotations for variant positions"
KNGMH

SEQ ID NO: 576 - protein, 7 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  SITE (1)..(7): /note="Variant residues given in the sequence have no preference with respect to those in the annotations for variant positions"
GFTFSKN

SEQ ID NO: 577 - protein, 17 aa, Artificial Sequence
  source: /note="Description of Artificial Sequence: Synthetic peptide"
  VARIANT (1)..(1): /replace="Leu"
  VARIANT (8)..(8): /replace="Arg"
  SITE (1)..(17): /note="Variant residues given in the sequence have no preference with respect to those in the annotations for variant positions"
MIYYDSSKMYYADTVKG

SEQ ID NO: 578 - protein, 6 aa, Artificial Sequence
  source: /note="Description of Artificial Sequence: Synthetic peptide"
  VARIANT (6)..(6): /replace="Arg"
  SITE (1)..(6): /note="Variant residues given in the sequence have no preference with respect to those in the annotations for variant positions"
YYDSSK

SEQ ID NO: 579 - protein, 8 aa, Artificial Sequence
  source: /note="Description of Artificial Sequence: Synthetic peptide"
  VARIANT (7)..(7): /replace="Arg"
  SITE (1)..(8): /note="Variant residues given in the sequence have no preference with respect to those in the annotations for variant positions"
IYYDSSKM

SEQ ID NO: 580 - protein, 9 aa, Artificial Sequence
  source: /note="Description of Artificial Sequence: Synthetic peptide"
  VARIANT (1)..(1): /replace="Tyr" or "Ser"
  VARIANT (2)..(2): /replace="Tyr" or "Ser" or "Thr"
  VARIANT (3)..(3): /replace="Tyr" or "Ser" or "Thr"
  VARIANT (9)..(9): /replace="Tyr"
  SITE (1)..(9): /note="Variant residues given in the sequence have no preference with respect to those in the annotations for variant positions"
FWWDLDFDH

SEQ ID NO: 581 - protein, 11 aa, Artificial Sequence
  source: /note="Description of Artificial Sequence: Synthetic peptide"
  VARIANT (2)..(2): /replace="Lys"
  VARIANT (3)..(3): /replace="Tyr" or "Ser"
  VARIANT (4)..(4): /replace="Tyr" or "Ser" or "Thr"
  VARIANT (5)..(5): /replace="Tyr" or "Ser" or "Thr"
  VARIANT (11)..(11): /replace="Tyr"
  SITE (1)..(11): /note="Variant residues given in the sequence have no preference with respect to those in the annotations for variant positions"
ASFWWDLDFDH

SEQ ID NO: 582 - protein, 8 aa, Artificial Sequence
  source: /note="Description of Artificial Sequence: Synthetic peptide"
AALNSEYD

SEQ ID NO: 583 - protein, 6 aa, Artificial Sequence
  source: /note="Description of Artificial Sequence: Synthetic peptide"
LNSEYD

SEQ ID NO: 584 - protein, 16 aa, Artificial Sequence
  source: /note="Description of Artificial Sequence: Synthetic peptide"
  VARIANT (2)..(2): /replace="Gly"
  VARIANT (6)..(6): /replace="Leu"
  VARIANT (7)..(7): /replace="Gly"
  VARIANT (8)..(8): /replace="Asn"
  VARIANT (10)..(10): /replace="Glu" or "Leu"
  VARIANT (11)..(11): /replace="Asn" or "Glu"
  SITE (1)..(16): /note="Variant residues given in the sequence have no preference with respect to those in the annotations for variant positions"
RSSQSIVRSDGTTYFN

SEQ ID NO: 585 - protein, 10 aa, Artificial Sequence
  source: /note="Description of Artificial Sequence: Synthetic peptide"
  VARIANT (3)..(3): /replace="Leu"
  VARIANT (4)..(4): /replace="Gly"
  VARIANT (5)..(5): /replace="Asn"
  VARIANT (7)..(7): /replace="Glu" or "Leu"
  SITE (1)..(10): /note="Variant residues given in the sequence have no preference with respect to those in the annotations for variant positions"
QSIVRSDTTY

SEQ ID NO: 586 - protein, 12 aa, Artificial Sequence
  source: /note="Description of Artificial Sequence: Synthetic peptide"
  VARIANT (4)..(4): /replace="Leu"
  VARIANT (5)..(5): /replace="Gly"
  VARIANT (6)..(6): /replace="Asn"
  VARIANT (8)..(8): /replace="Glu" or "Leu"
  VARIANT (9)..(9): /replace="Asn" or "Glu"
  SITE (1)..(12): /note="Variant residues given in the sequence have no preference with respect to those in the annotations for variant positions"
SQSIVRSDGTTY

SEQ ID NO: 587 - protein, 11 aa, Artificial Sequence
  source: /note="Description of Artificial Sequence: Synthetic peptide"
  VARIANT (2)..(2): /replace="Gly"
  VARIANT (6)..(6): /replace="Leu"
  VARIANT (7)..(7): /replace="Gly"
  VARIANT (8)..(8): /replace="Asn"
  VARIANT (10)..(10): /replace="Glu" or "Leu"
  VARIANT (11)..(11): /replace="Asn" or "Glu"
  SITE (1)..(11): /note="Variant residues given in the sequence have no preference with respect to those in the annotations for variant positions"
RSSQSIVRSDG

SEQ ID NO: 588 - protein, 7 aa, Artificial Sequence
  source: /note="Description of Artificial Sequence: Synthetic peptide"
  VARIANT (4)..(4): /replace="Leu"
  VARIANT (5)..(5): /replace="Gly"
  VARIANT (6)..(6): /replace="Asn"
  SITE (1)..(7): /note="Variant residues given in the sequence have no preference with respect to those in the annotations for variant positions"
SQSIVRS

SEQ ID NO: 589 - protein, 6 aa, Artificial Sequence
  source: /note="Description of Artificial Sequence: Synthetic peptide"
  VARIANT (3)..(3): /replace="Leu"
  VARIANT (4)..(4): /replace="Gly"
  VARIANT (5)..(5): /replace="Asn"
  SITE (1)..(6): /note="Variant residues given in the sequence have no preference with respect to those in the annotations for variant positions"
QSIVRS

SEQ ID NO: 590 - protein, 7 aa, Artificial Sequence
  source: /note="Description of Artificial Sequence: Synthetic peptide"
  VARIANT (1)..(1): /replace="Ser"
  VARIANT (2)..(2): /replace="Thr"
  VARIANT (4)..(4): /replace="Thr"
  VARIANT (5)..(5): /replace="Leu"
  VARIANT (6)..(6): /replace="Glu"
  VARIANT (7)..(7): /replace="Tyr"
  SITE (1)..(7): /note="Variant residues given in the sequence have no preference with respect to those in the annotations for variant positions"
RVSNRFS

SEQ ID NO: 591 - protein, 3 aa, Artificial Sequence
  source: /note="Description of Artificial Sequence: Synthetic peptide"
  VARIANT (1)..(1): /replace="Ser"
  VARIANT (2)..(2): /replace="Thr"
  SITE (1)..(3): /note="Variant residues given in the sequence have no preference with respect to those in the annotations for variant positions"
RVS

SEQ ID NO: 592 - protein, 9 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  VARIANT (6)..(6): /replace="Tyr"
  VARIANT (8)..(8): /replace="Tyr"
  SITE (1)..(9): /note="Variant residues given in the sequence have no preference with respect to those in the annotations for variant positions"
LQSSHFPWT

SEQ ID NO: 593 - protein, 6 aa, Artificial Sequence
  source: /note="Description of Artificial Sequence: Synthetic peptide"
  VARIANT (1)..(1): /replace="Tyr"
  VARIANT (2)..(2): /replace="Ala"
  VARIANT (3)..(3): /replace="Thr"
  VARIANT (4)..(4): /replace="Tyr"
  VARIANT (6)..(6): /replace="Tyr"
  SITE (1)..(6): /note="Variant residues given in the sequence have no preference with respect to those in the annotations for variant positions"
SSHFPW

SEQ ID NO: 594 - protein, 5 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  SITE (1)..(5): /note="Variant residues given in the sequence have no preference with respect to those in the annotations for variant positions"
LQSSH

SEQ ID NO: 595 - protein, 8 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  VARIANT (6)..(6): /replace="Tyr"
  VARIANT (8)..(8): /replace="Tyr"
  SITE (1)..(8): /note="Variant residues given in the sequence have no preference with respect to those in the annotations for variant positions"
LQSSHFPW

SEQ ID NO: 596 - protein, 10 aa, Artificial Sequence
  source: /note="Description of Artificial Sequence: Synthetic peptide"
  VARIANT (9)..(9): /replace="Ile"
  SITE (1)..(10): /note="Variant residues given in the sequence have no preference with respect to those in the annotations for variant positions"
GFSLTTYNVH

SEQ ID NO: 597 - protein, 8 aa, Artificial Sequence
  source: /note="Description of Artificial Sequence: Synthetic peptide"
GFSLTTYN

SEQ ID NO: 598 - protein, 5 aa, Artificial Sequence
  source: /note="Description of Artificial Sequence: Synthetic peptide"
  VARIANT (4)..(4): /replace="Ile"
  SITE (1)..(5): /note="Variant residues given in the sequence have no preference with respect to those in the annotations for variant positions"
TYNVH

SEQ ID NO: 599 - protein, 7 aa, Artificial Sequence
  source: /note="Description of Artificial Sequence: Synthetic peptide"
GFSLTTY

SEQ ID NO: 600 - protein, 16 aa, Artificial Sequence
  source: /note="Description of Artificial Sequence: Synthetic peptide"
  VARIANT (10)..(10): /replace="Tyr"
  VARIANT (11)..(11): /replace="Ser"
  VARIANT (12)..(12): /replace="Ser"
  VARIANT (15)..(15): /replace="Lys"
  SITE (1)..(16): /note="Variant residues given in the sequence have no preference with respect to those in the annotations for variant positions"
RMRYSGDTSFNAALTS

SEQ ID NO: 601 - protein, 5 aa, Artificial Sequence
  source: /note="Description of Artificial Sequence: Synthetic peptide"
RYSGD

SEQ ID NO: 602 - protein, 7 aa, Artificial Sequence
  source: /note="Description of Artificial Sequence: Synthetic peptide"
MRYSGDT

SEQ ID NO: 603 - protein, 15 aa, Artificial Sequence
  source: /note="Description of Artificial Sequence: Synthetic peptide"
  VARIANT (7)..(7): /replace="Gly"
  VARIANT (9)..(9): /replace="Ala"
  SITE (1)..(15): /note="Variant residues given in the sequence have no preference with respect to those in the annotations for variant positions"
DPMYIPNYSYGVMNA

SEQ ID NO: 604 - protein, 17 aa, Artificial Sequence
  source: /note="Description of Artificial Sequence: Synthetic peptide"
  VARIANT (1)..(1): /replace="Ala"
  VARIANT (2)..(2): /replace="Arg"
  VARIANT (9)..(9): /replace="Gly"
  VARIANT (11)..(11): /replace="Ala"
  SITE (1)..(17): /note="Variant residues given in the sequence have no preference with respect to those in the annotations for variant positions"
TSDPMYIPNYSYGVMNA

SEQ ID NO: 605 - protein, 11 aa, Artificial Sequence
  source: /note="Description of Artificial Sequence: Synthetic peptide"
  VARIANT (2)..(2): /replace="Thr" or "Ser"
  VARIANT (7)..(7): /replace="Asp"
  VARIANT (8)..(8): /replace="Lys"
  SITE (1)..(11): /note="Variant residues given in the sequence have no preference with respect to those in the annotations for variant positions"
KASQNINNYLN

SEQ ID NO: 606 - protein, 7 aa, Artificial Sequence
  source: /note="Description of Artificial Sequence: Synthetic peptide"
  VARIANT (5)..(5): /replace="Asp"
  VARIANT (6)..(6): /replace="Lys"
  SITE (1)..(7): /note="Variant residues given in the sequence have no preference with respect to those in the annotations for variant positions"
SQNINNY

SEQ ID NO: 607 - protein, 6 aa, Artificial Sequence
  source: /note="Description of Artificial Sequence: Synthetic peptide"
  VARIANT (4)..(4): /replace="Asp"
  VARIANT (5)..(5): /replace="Lys"
  SITE (1)..(6): /note="Variant residues given in the sequence have no preference with respect to those in the annotations for variant positions"
QNINNY

SEQ ID NO: 608 - protein, 10 aa, Artificial Sequence
  source: /note="Description of Artificial Sequence: Synthetic peptide"
  VARIANT (3)..(3): /replace="Asn"
  VARIANT (4)..(4): /replace="Asn"
  VARIANT (6)..(6): /replace="Glu"
  SITE (1)..(10): /note="Variant residues given in the sequence have no preference with respect to those in the annotations for variant positions"
NTDHLQAGVP

SEQ ID NO: 609 - protein, 7 aa, Artificial Sequence
  source: /note="Description of Artificial Sequence: Synthetic peptide"
  VARIANT (3)..(3): /replace="Asn"
  VARIANT (4)..(4): /replace="Asn"
  VARIANT (6)..(6): /replace="Glu"
  SITE (1)..(7): /note="Variant residues given in the sequence have no preference with respect to those in the annotations for variant positions"
NTDHLQA

SEQ ID NO: 610 - protein, 3 aa, Artificial Sequence
  source: /note="Description of Artificial Sequence: Synthetic peptide"
  VARIANT (3)..(3): /replace="Asn"
  SITE (1)..(3): /note="Variant residues given in the sequence have no preference with respect to those in the annotations for variant positions"
NTD

SEQ ID NO: 611 - protein, 8 aa, Artificial Sequence
  source: /note="Description of Artificial Sequence: Synthetic peptide"
  VARIANT (6)..(6): /replace="Ser" or "Gly"
  SITE (1)..(8): /note="Variant residues given in the sequence have no preference with respect to those in the annotations for variant positions"
LQHRSRYT

SEQ ID NO: 612 - protein, 5 aa, Artificial Sequence
  source: /note="Description of Artificial Sequence: Synthetic peptide"
  VARIANT (4)..(4): /replace="Ser" or "Gly"
  SITE (1)..(5): /note="Variant residues given in the sequence have no preference with respect to those in the annotations for variant positions"
HRSRY

SEQ ID NO: 613 - protein, 10 aa, Artificial Sequence
  source: /note="Description of Artificial Sequence: Synthetic peptide"
GYTFTSYYIY

SEQ ID NO: 614 - protein, 8 aa, Artificial Sequence
  source: /note="Description of Artificial Sequence: Synthetic peptide"
GYTFTSYY

SEQ ID NO: 615 - protein, 5 aa, Artificial Sequence
  source: /note="Description of Artificial Sequence: Synthetic peptide"
SYYIY

SEQ ID NO: 616 - protein, 17 aa, Artificial Sequence
  source: /note="Description of Artificial Sequence: Synthetic peptide"
  VARIANT (5)..(5): /replace="Ala"
  VARIANT (6)..(6): /replace="Asn"
  VARIANT (7)..(7): /replace="Gly"
  VARIANT (8)..(8): /replace="Gly"
  VARIANT (14)..(14): /replace="Lys"
  SITE (1)..(17): /note="Variant residues given in the sequence have no preference with respect to those in the annotations for variant positions"
YIYPGHDAIYYSENFKG

SEQ ID NO: 617 - protein, 6 aa, Artificial Sequence
  source: /note="Description of Artificial Sequence: Synthetic peptide"
  VARIANT (3)..(3): /replace="Ala"
  VARIANT (4)..(4): /replace="Asn"
  VARIANT (5)..(5): /replace="Gly"
  VARIANT (6)..(6): /replace="Gly"
  SITE (1)..(6): /note="Variant residues given in the sequence have no preference with respect to those in the annotations for variant positions"
YPGHDA

SEQ ID NO: 618 - protein, 8 aa, Artificial Sequence
  source: /note="Description of Artificial Sequence: Synthetic peptide"
  VARIANT (4)..(4): /replace="Ala"
  VARIANT (5)..(5): /replace="Asn"
  VARIANT (6)..(6): /replace="Gly"
  VARIANT (7)..(7): /replace="Gly"
  SITE (1)..(8): /note="Variant residues given in the sequence have no preference with respect to those in the annotations for variant positions"
IYPGHDAI

SEQ ID NO: 619 - protein, 12 aa, Artificial Sequence
  source: /note="Description of Artificial Sequence: Synthetic peptide"
  VARIANT (1)..(1): /replace="Ala"
  VARIANT (4)..(4): /replace="Val"
  VARIANT (11)..(11): /replace="Val"
  VARIANT (12)..(12): /replace="Phe"
  SITE (1)..(12): /note="Variant residues given in the sequence have no preference with respect to those in the annotations for variant positions"
VRPNTMMAPLAY

SEQ ID NO: 620 - protein, 10 aa, Artificial Sequence
  source: /note="Description of Artificial Sequence: Synthetic peptide"
  VARIANT (2)..(2): /replace="Val"
  VARIANT (9)..(9): /replace="Val"
  VARIANT (10)..(10): /replace="Phe"
  SITE (1)..(10): /note="Variant residues given in the sequence have no preference with respect to those in the annotations for variant positions"
PNTMMAPLAY

SEQ ID NO: 621 - protein, 16 aa, Artificial Sequence
  source: /note="Description of Artificial Sequence: Synthetic peptide"
  VARIANT (7)..(7): /replace="Val"
  VARIANT (10)..(10): /replace="His"
  SITE (1)..(16): /note="Variant residues given in the sequence have no preference with respect to those in the annotations for variant positions"
RSSQSLIYSIGNTYLH

SEQ ID NO: 622 - protein, 12 aa, Artificial Sequence
  source: /note="Description of Artificial Sequence: Synthetic peptide"
  VARIANT (5)..(5): /replace="Val"
  VARIANT (8)..(8): /replace="His"
  SITE (1)..(12): /note="Variant residues given in the sequence have no preference with respect to those in the annotations for variant positions"
SQSLIYSIGNTY

SEQ ID NO: 623 - protein, 11 aa, Artificial Sequence
  source: /note="Description of Artificial Sequence: Synthetic peptide"
  VARIANT (4)..(4): /replace="Val"
  VARIANT (7)..(7): /replace="His"
  SITE (1)..(11): /note="Variant residues given in the sequence have no preference with respect to those in the annotations for variant positions"
QSLIYSIGNTY

SEQ ID NO: 624 - protein, 7 aa, Artificial Sequence
  source: /note="Description of Artificial Sequence: Synthetic peptide"
RVSNRFS

SEQ ID NO: 625 - protein, 3 aa, Artificial Sequence
  source: /note="Description of Artificial Sequence: Synthetic peptide"
RVS

SEQ ID NO: 626 - protein, 9 aa, Artificial Sequence
  source: /note="Description of Artificial Sequence: Synthetic peptide"
FQSTHLPYT

SEQ ID NO: 627 - protein, 6 aa, Artificial Sequence
  source: /note="Description of Artificial Sequence: Synthetic peptide"
STHLPY

SEQ ID NO: 628 - protein, 5 aa, Artificial Sequence
  source: /note="Description of Artificial Sequence: Synthetic peptide"
KNGMH

SEQ ID NO: 629 - protein, 5 aa, Artificial Sequence
  source: /note="Description of Artificial Sequence: Synthetic peptide"
TYNVH

SEQ ID NO: 630 - protein, 5 aa, Artificial Sequence
  source: /note="Description of Artificial Sequence: Synthetic peptide"
TYNIH

SEQ ID NO: 631 - protein, 5 aa, Artificial Sequence
  source: /note="Description of Artificial Sequence: Synthetic peptide"
KYGMS

SEQ ID NO: 632 - protein, 5 aa, Artificial Sequence
  source: /note="Description of Artificial Sequence: Synthetic peptide"
KQGMH

SEQ ID NO: 633 - protein, 5 aa, Artificial Sequence
  source: /note="Description of Artificial Sequence: Synthetic peptide"
KNQMH

SEQ ID NO: 634 - protein, 17 aa, Artificial Sequence
  source: /note="Description of Artificial Sequence: Synthetic peptide"
MIYYDSSKMYYADTVKG

SEQ ID NO: 635 - protein, 17 aa, Artificial Sequence
  source: /note="Description of Artificial Sequence: Synthetic peptide"
YIYPGHDAIYYSENFKG

SEQ ID NO: 636 - protein, 16 aa, Artificial Sequence
  source: /note="Description of Artificial Sequence: Synthetic peptide"
RMRYSGDTSFNAALTS

SEQ ID NO: 637 - protein, 17 aa, Artificial Sequence
  source: /note="Description of Artificial Sequence: Synthetic peptide"
YIYPANGGIYYSEKFKG

SEQ ID NO: 638 - protein, 17 aa, Artificial Sequence
  source: /note="Description of Artificial Sequence: Synthetic peptide"
MIYYDSSRMYYADTVKG

SEQ ID NO: 639 - protein, 16 aa, Artificial Sequence
  source: /note="Description of Artificial Sequence: Synthetic peptide"
RMRYSGDTSYSSALKS

SEQ ID NO: 640 - protein, 17 aa, Artificial Sequence
  source: /note="Description of Artificial Sequence: Synthetic peptide"
LIYYDSSKMNYADTVKG

SEQ ID NO: 641 - protein, 9 aa, Artificial Sequence
  source: /note="Description of Artificial Sequence: Synthetic peptide"
FWWDLDFDH

SEQ ID NO: 642 - protein, 10 aa, Artificial Sequence
  source: /note="Description of Artificial Sequence: Synthetic peptide"
PNTMMAPLAY

SEQ ID NO: 643 - protein, 15 aa, Artificial Sequence
  source: /note="Description of Artificial Sequence: Synthetic peptide"
DPMYIPNYSYGVMNA

SEQ ID NO: 644 - protein, 10 aa, Artificial Sequence
  source: /note="Description of Artificial Sequence: Synthetic peptide"
PVTMMAPLVF

SEQ ID NO: 645 - protein, 9 aa, Artificial Sequence
  source: /note="Description of Artificial Sequence: Synthetic peptide"
FWWDLDFDY

SEQ ID NO: 646 - protein, 15 aa, Artificial Sequence
  source: /note="Description of Artificial Sequence: Synthetic peptide"
DPMYIPGYSYGVMNA

SEQ ID NO: 647 - protein, 9 aa, Artificial Sequence
  source: /note="Description of Artificial Sequence: Synthetic peptide"
FYYDLDFDH

SEQ ID NO: 648 - protein, 9 aa, Artificial Sequence
  source: /note="Description of Artificial Sequence: Synthetic peptide"
FSSDLDFDH

SEQ ID NO: 649 - protein, 9 aa, Artificial Sequence
  source: /note="Description of Artificial Sequence: Synthetic peptide"
FWSDLDFDH

SEQ ID NO: 650 - protein, 9 aa, Artificial Sequence
  source: /note="Description of Artificial Sequence: Synthetic peptide"
FSWDLDFDH

SEQ ID NO: 651 - protein, 9 aa, Artificial Sequence
  source: /note="Description of Artificial Sequence: Synthetic peptide"
FTTDLDFDH

SEQ ID NO: 652 - protein, 9 aa, Artificial Sequence
  source: /note="Description of Artificial Sequence: Synthetic peptide"
FTWDLDFDH

SEQ ID NO: 653 - protein, 9 aa, Artificial Sequence
  source: /note="Description of Artificial Sequence: Synthetic peptide"
FWTDLDFDH

SEQ ID NO: 654 - protein, 15 aa, Artificial Sequence
  source: /note="Description of Artificial Sequence: Synthetic peptide"
DPMYIPNYAYGVMNA

SEQ ID NO: 655 - protein, 9 aa, Artificial Sequence
  source: /note="Description of Artificial Sequence: Synthetic peptide"
YYYDLDFDH

SEQ ID NO: 656 - protein, 9 aa, Artificial Sequence
  source: /note="Description of Artificial Sequence: Synthetic peptide"
SYYDLDFDH

SEQ ID NO: 657 - protein, 9 aa, Artificial Sequence
  source: /note="Description of Artificial Sequence: Synthetic peptide"
YSSDLDFDH

SEQ ID NO: 658 - protein, 9 aa, Artificial Sequence
  source: /note="Description of Artificial Sequence: Synthetic peptide"
SSSDLDFDH

SEQ ID NO: 659 - protein, 9 aa, Artificial Sequence
  source: /note="Description of Artificial Sequence: Synthetic peptide"
YWSDLDFDH

SEQ ID NO: 660 - protein, 9 aa, Artificial Sequence
  source: /note="Description of Artificial Sequence: Synthetic peptide"
SWSDLDFDH

SEQ ID NO: 661 - protein, 9 aa, Artificial Sequence
  source: /note="Description of Artificial Sequence: Synthetic peptide"
YSWDLDFDH

SEQ ID NO: 662 - protein, 9 aa, Artificial Sequence
  source: /note="Description of Artificial Sequence: Synthetic peptide"
SSWDLDFDH

SEQ ID NO: 663 - protein, 9 aa, Artificial Sequence
  source: /note="Description of Artificial Sequence: Synthetic peptide"
YTWDLDFDH

SEQ ID NO: 664 - protein, 9 aa, Artificial Sequence
  source: /note="Description of Artificial Sequence: Synthetic peptide"
STWDLDFDH

SEQ ID NO: 665 - protein, 9 aa, Artificial Sequence
  source: /note="Description of Artificial Sequence: Synthetic peptide"
YTTDLDFDH

SEQ ID NO: 666 - protein, 9 aa, Artificial Sequence
  source: /note="Description of Artificial Sequence: Synthetic peptide"
STTDLDFDH

SEQ ID NO: 667 - protein, 9 aa, Artificial Sequence
  source: /note="Description of Artificial Sequence: Synthetic peptide"
YWWDLDFDH

SEQ ID NO: 668 - protein, 9 aa, Artificial Sequence
  source: /note="Description of Artificial Sequence: Synthetic peptide"
SWWDLDFDH

SEQ ID NO: 669 - protein, 16 aa, Artificial Sequence
  source: /note="Description of Artificial Sequence: Synthetic peptide"
RSSQSLVRSDGTTYFN

SEQ ID NO: 670 - protein, 16 aa, Artificial Sequence
  source: /note="Description of Artificial Sequence: Synthetic peptide"
RSSQSLIYSIGNTYLH

SEQ ID NO: 671 - protein, 11 aa, Artificial Sequence
  source: /note="Description of Artificial Sequence: Synthetic peptide"
KASQNINNYLN

SEQ ID NO: 672 - protein, 16 aa, Artificial Sequence
  source: /note="Description of Artificial Sequence: Synthetic peptide"
RSSQSLVYSHGNTYLH

SEQ ID NO: 673 - protein, 11 aa, Artificial Sequence
  source: /note="Description of Artificial Sequence: Synthetic peptide"
KTSQNIDKYLN

SEQ ID NO: 674 - protein, 11 aa, Artificial Sequence
  source: /note="Description of Artificial Sequence: Synthetic peptide"
RGSQSIGNSLN

SEQ ID NO: 675 - protein, 11 aa, Artificial Sequence
  source: /note="Description of Artificial Sequence: Synthetic peptide"
KSSQNIDKYLN

SEQ ID NO: 676 - protein, 16 aa, Artificial Sequence
  source: /note="Description of Artificial Sequence: Synthetic peptide"
RSSQSLVRSEGTTYFN

SEQ ID NO: 677 - protein, 7 aa, Artificial Sequence
  source: /note="Description of Artificial Sequence: Synthetic peptide"
NTDHLQA

SEQ ID NO: 678 - protein, 7 aa, Artificial Sequence
  source: /note="Description of Artificial Sequence: Synthetic peptide"
NTNNLEA

SEQ ID NO: 679 - protein, 7 aa, Artificial Sequence
  source: /note="Description of Artificial Sequence: Synthetic peptide"
STSTLEY

SEQ ID NO: 680 - protein, 9 aa, Artificial Sequence
  source: /note="Description of Artificial Sequence: Synthetic peptide"
LQSSHFPWT

SEQ ID NO: 681 - protein, 8 aa, Artificial Sequence
  source: /note="Description of Artificial Sequence: Synthetic peptide"
LQHRSRYT

SEQ ID NO: 682 - protein, 8 aa, Artificial Sequence
  source: /note="Description of Artificial Sequence: Synthetic peptide"
LQHRSSYT

SEQ ID NO: 683 - protein, 9 aa, Artificial Sequence
  source: /note="Description of Artificial Sequence: Synthetic peptide"
LQYATYPYT

SEQ ID NO: 684 - protein, 8 aa, Artificial Sequence
  source: /note="Description of Artificial Sequence: Synthetic peptide"
LQHRSGYT

SEQ ID NO: 685 - protein, 5 aa, Artificial Sequence
  source: /note="Description of Artificial Sequence: Synthetic peptide"
LQSSH

SEQ ID NO: 686 - protein, 7 aa, Artificial Sequence
  source: /note="Description of Artificial Sequence: Synthetic peptide"
GFTFSKN

SEQ ID NO: 687 - protein, 7 aa, Artificial Sequence
  source: /note="Description of Artificial Sequence: Synthetic peptide"
GFAFRKY

SEQ ID NO: 688 - protein, 7 aa, Artificial Sequence
  source: /note="Description of Artificial Sequence: Synthetic peptide"
GFTFSKQ

SEQ ID NO: 689 - protein, 6 aa, Artificial Sequence
  source: /note="Description of Artificial Sequence: Synthetic peptide"
YYDSSK

SEQ ID NO: 690 - protein, 6 aa, Artificial Sequence
  source: /note="Description of Artificial Sequence: Synthetic peptide"
YPGHDA

SEQ ID NO: 691 - protein, 6 aa, Artificial Sequence
  source: /note="Description of Artificial Sequence: Synthetic peptide"
YPANGG

SEQ ID NO: 692 - protein, 6 aa, Artificial Sequence
  source: /note="Description of Artificial Sequence: Synthetic peptide"
YYDSSR

SEQ ID NO: 693 - protein, 12 aa, Artificial Sequence
  source: /note="Description of Artificial Sequence: Synthetic peptide"
SQSLVRSDGTTY

SEQ ID NO: 694 - protein, 12 aa, Artificial Sequence
  source: /note="Description of Artificial Sequence: Synthetic peptide"
SQSLIYSIGNTY

SEQ ID NO: 695 - protein, 7 aa, Artificial Sequence
  source: /note="Description of Artificial Sequence: Synthetic peptide"
SQNINNY

SEQ ID NO: 696 - protein, 12 aa, Artificial Sequence
  source: /note="Description of Artificial Sequence: Synthetic peptide"
SQSLVYSHGNTY

SEQ ID NO: 697 - protein, 7 aa, Artificial Sequence
  source: /note="Description of Artificial Sequence: Synthetic peptide"
SQNIDKY

SEQ ID NO: 698 - protein, 7 aa, Artificial Sequence
  source: /note="Description of Artificial Sequence: Synthetic peptide"
SQSIGNS

SEQ ID NO: 699 - protein, 12 aa, Artificial Sequence
  source: /note="Description of Artificial Sequence: Synthetic peptide"
SQSLVRSEGTTY

SEQ ID NO: 700 - protein, 3 aa, Artificial Sequence
  source: /note="Description of Artificial Sequence: Synthetic peptide"
NTD

SEQ ID NO: 701 - protein, 3 aa, Artificial Sequence
  source: /note="Description of Artificial Sequence: Synthetic peptide"
NTN

SEQ ID NO: 702 - protein, 3 aa, Artificial Sequence
  source: /note="Description of Artificial Sequence: Synthetic peptide"
STS

SEQ ID NO: 703 - protein, 6 aa, Artificial Sequence
  source: /note="Description of Artificial Sequence: Synthetic peptide"
SSHFPW

SEQ ID NO: 704 - protein, 5 aa, Artificial Sequence
  source: /note="Description of Artificial Sequence: Synthetic peptide"
HRSRY

SEQ ID NO: 705 - protein, 5 aa, Artificial Sequence
  source: /note="Description of Artificial Sequence: Synthetic peptide"
HRSSY

SEQ ID NO: 706 - protein, 6 aa, Artificial Sequence
  source: /note="Description of Artificial Sequence: Synthetic peptide"
YATYPY

SEQ ID NO: 707 - protein, 5 aa, Artificial Sequence
  source: /note="Description of Artificial Sequence: Synthetic peptide"
HRSGY

SEQ ID NO: 708 - protein, 8 aa, Artificial Sequence
  source: /note="Description of Artificial Sequence: Synthetic peptide"
GFTFSKNG

SEQ ID NO: 709 - protein, 8 aa, Artificial Sequence
  source: /note="Description of Artificial Sequence: Synthetic peptide"
GFAFRKYG

SEQ ID NO: 710 - protein, 8 aa, Artificial Sequence
  source: /note="Description of Artificial Sequence: Synthetic peptide"
GFTFSKQG

SEQ ID NO: 711 - protein, 8 aa, Artificial Sequence
  source: /note="Description of Artificial Sequence: Synthetic peptide"
IYYDSSKM

SEQ ID NO: 712 - protein, 8 aa, Artificial Sequence
  source: /note="Description of Artificial Sequence: Synthetic peptide"
IYPGHDAI

SEQ ID NO: 713 - protein, 8 aa, Artificial Sequence
  source: /note="Description of Artificial Sequence: Synthetic peptide"
IYPANGGI

SEQ ID NO: 714 - protein, 8 aa, Artificial Sequence
  source: /note="Description of Artificial Sequence: Synthetic peptide"
IYYDSSRM

SEQ ID NO: 715 - protein, 11 aa, Artificial Sequence
  source: /note="Description of Artificial Sequence: Synthetic peptide"
ASFWWDLDFDH

SEQ ID NO: 716 - protein, 12 aa, Artificial Sequence
  source: /note="Description of Artificial Sequence: Synthetic peptide"
VRPNTMMAPLAY

SEQ ID NO: 717 - protein, 17 aa, Artificial Sequence
  source: /note="Description of Artificial Sequence: Synthetic peptide"
TSDPMYIPNYSYGVMNA

SEQ ID NO: 718 - protein, 17 aa, Artificial Sequence
  source: /note="Description of Artificial Sequence: Synthetic peptide"
ARDPMYIPNYSYGVMNA

SEQ ID NO: 719 - protein, 12 aa, Artificial Sequence
  source: /note="Description of Artificial Sequence: Synthetic peptide"
ARPVTMMAPLVF

SEQ ID NO: 720 - protein, 11 aa, Artificial Sequence
  source: /note="Description of Artificial Sequence: Synthetic peptide"
ASFWWDLDFDY

SEQ ID NO: 721 - protein, 17 aa, Artificial Sequence
  source: /note="Description of Artificial Sequence: Synthetic peptide"
TRDPMYIPGYSYGVMNA

SEQ ID NO: 722 - protein, 11 aa, Artificial Sequence
  source: /note="Description of Artificial Sequence: Synthetic peptide"
AKFWWDLDFDH

SEQ ID NO: 723 - protein, 11 aa, Artificial Sequence
  source: /note="Description of Artificial Sequence: Synthetic peptide"
ASFYYDLDFDH

SEQ ID NO: 724 - protein, 11 aa, Artificial Sequence
  source: /note="Description of Artificial Sequence: Synthetic peptide"
ASFSSDLDFDH

SEQ ID NO: 725 - protein, 11 aa, Artificial Sequence
  source: /note="Description of Artificial Sequence: Synthetic peptide"
ASFWSDLDFDH

SEQ ID NO: 726 - protein, 11 aa, Artificial Sequence
  source: /note="Description of Artificial Sequence: Synthetic peptide"
ASFSWDLDFDH

SEQ ID NO: 727 - protein, 11 aa, Artificial Sequence
  source: /note="Description of Artificial Sequence: Synthetic peptide"
ASFTTDLDFDH

SEQ ID NO: 728 - protein, 11 aa, Artificial Sequence
  source: /note="Description of Artificial Sequence: Synthetic peptide"
ASFTWDLDFDH

SEQ ID NO: 729 - protein, 11 aa, Artificial Sequence
  source: /note="Description of Artificial Sequence: Synthetic peptide"
ASFWTDLDFDH

SEQ ID NO: 730 - protein, 17 aa, Artificial Sequence
  source: /note="Description of Artificial Sequence: Synthetic peptide"
ASDPMYIPNYAYGVMNA

SEQ ID NO: 731 - protein, 11 aa, Artificial Sequence
  source: /note="Description of Artificial Sequence: Synthetic peptide"
ASYYYDLDFDH

SEQ ID NO: 732 - protein, 11 aa, Artificial Sequence
  source: /note="Description of Artificial Sequence: Synthetic peptide"
ASSYYDLDFDH

SEQ ID NO: 733 - protein, 11 aa, Artificial Sequence
  source: /note="Description of Artificial Sequence: Synthetic peptide"
ASYSSDLDFDH

SEQ ID NO: 734 - protein, 11 aa, Artificial Sequence
  source: /note="Description of Artificial Sequence: Synthetic peptide"
ASSSSDLDFDH

SEQ ID NO: 735 - protein, 11 aa, Artificial Sequence
  source: /note="Description of Artificial Sequence: Synthetic peptide"
ASYWSDLDFDH

SEQ ID NO: 736 - protein, 11 aa, Artificial Sequence
  source: /note="Description of Artificial Sequence: Synthetic peptide"
ASSWSDLDFDH

SEQ ID NO: 737 - protein, 11 aa, Artificial Sequence
  source: /note="Description of Artificial Sequence: Synthetic peptide"
ASYSWDLDFDH

SEQ ID NO: 738 - protein, 11 aa, Artificial Sequence
  source: /note="Description of Artificial Sequence: Synthetic peptide"
ASSSWDLDFDH

SEQ ID NO: 739 - protein, 11 aa, Artificial Sequence
  source: /note="Description of Artificial Sequence: Synthetic peptide"
ASYTWDLDFDH

SEQ ID NO: 740 - protein, 11 aa, Artificial Sequence
  source: /note="Description of Artificial Sequence: Synthetic peptide"
ASSTWDLDFDH

SEQ ID NO: 741 - protein, 11 aa, Artificial Sequence
  source: /note="Description of Artificial Sequence: Synthetic peptide"
ASYTTDLDFDH

SEQ ID NO: 742 - protein, 11 aa, Artificial Sequence
  source: /note="Description of Artificial Sequence: Synthetic peptide"
ASSTTDLDFDH

SEQ ID NO: 743 - protein, 11 aa, Artificial Sequence
  source: /note="Description of Artificial Sequence: Synthetic peptide"
ASYWWDLDFDH

SEQ ID NO: 744 - protein, 11 aa, Artificial Sequence
  source: /note="Description of Artificial Sequence: Synthetic peptide"
ASSWWDLDFDH

SEQ ID NO: 745 - protein, 11 aa, Artificial Sequence
  source: /note="Description of Artificial Sequence: Synthetic peptide"
QSLVRSDGTTY

SEQ ID NO: 746 - protein, 11 aa, Artificial Sequence
  source: /note="Description of Artificial Sequence: Synthetic peptide"
QSLIYSIGNTY

SEQ ID NO: 747 - protein, 6 aa, Artificial Sequence
  source: /note="Description of Artificial Sequence: Synthetic peptide"
QNINNY

SEQ ID NO: 748 - protein, 11 aa, Artificial Sequence
  source: /note="Description of Artificial Sequence: Synthetic peptide"
QSLVYSHGNTY

SEQ ID NO: 749 - protein, 6 aa, Artificial Sequence
  source: /note="Description of Artificial Sequence: Synthetic peptide"
QNIDKY

SEQ ID NO: 750 - protein, 6 aa, Artificial Sequence
  source: /note="Description of Artificial Sequence: Synthetic peptide"
QSIGNS

SEQ ID NO: 751 - protein, 11 aa, Artificial Sequence
  source: /note="Description of Artificial Sequence: Synthetic peptide"
QSLVRSEGTTY

SEQ ID NO: 752 - protein, 11 aa, Artificial Sequence
  source: /note="Description of Artificial Sequence: Synthetic peptide"
QSLVRSDETTY

SEQ ID NO: 753 - protein, 10 aa, Artificial Sequence
  source: /note="Description of Artificial Sequence: Synthetic peptide"
NTDHLQAGVP

SEQ ID NO: 754 - protein, 10 aa, Artificial Sequence
  source: /note="Description of Artificial Sequence: Synthetic peptide"
NTNNLEAGVP

SEQ ID NO: 755 - protein, 10 aa, Artificial Sequence
  source: /note="Description of Artificial Sequence: Synthetic peptide"
STSTLEYGVP

SEQ ID NO: 756 - protein, 10 aa, Artificial Sequence
  source: /note="Description of Artificial Sequence: Synthetic peptide"
GFTFSKNGMH

SEQ ID NO: 757 - protein, 10 aa, Artificial Sequence
  source: /note="Description of Artificial Sequence: Synthetic peptide"
GFSLTTYNVH

SEQ ID NO: 758 - protein, 10 aa, Artificial Sequence
  source: /note="Description of Artificial Sequence: Synthetic peptide"
GFSLTTYNIH

SEQ ID NO: 759 - protein, 10 aa, Artificial Sequence
  source: /note="Description of Artificial Sequence: Synthetic peptide"
GFAFRKYGMS

SEQ ID NO: 760 - protein, 10 aa, Artificial Sequence
  source: /note="Description of Artificial Sequence: Synthetic peptide"
GFTFSKQGMH

SEQ ID NO: 761 - protein, 8 aa, Artificial Sequence
  source: /note="Description of Artificial Sequence: Synthetic peptide"
LQSSHFPW

SEQ ID NO: 762 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWWDLDFDHWGQGTMVTVSS

SEQ ID NO: 763 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPGHDAIYYSENFKGRVTITADTSASTAYMELSSLRSEDTAVYYCVRPNTMMAPLAYWGQGTLVTVSS

SEQ ID NO: 764 - protein, 119 aa, Artificial Sequence
  source: /note="Description of Artificial Sequence: Synthetic polypeptide"
QVQLHQSGAELAKPGTSVNLSCKASGYTFTSYYIYWIKRRPGQGLEWIGYIYPGHDAIYYSENFKGKATFTADTSSSTAYMLLGSLTPEDSAYYFCVRPNTMMAPLAYWGQGTLVTVSS

SEQ ID NO: 765 - protein, 123 aa, Artificial Sequence
  source: /note="Description of Artificial Sequence: Synthetic polypeptide"
QVQLQESGPGLVKPSETLSLTCTVSGFSLTTYNVHWIRQPPGKGLEWIGRMRYSGDTSFNAALTSRVTISRDTSKNQVSLKLSSVTAADTAVYYCTSDPMYIPNYSYGVMNAWGQGTTVTVSS

SEQ ID NO: 766 - protein, 123 aa, Artificial Sequence
  source: /note="Description of Artificial Sequence: Synthetic polypeptide"
QVQLQESGPGLVKPSETLSLTCTVSGFSLTTYNVHWIRQPPGKGLEWIGRMRYSGDTSFNAALTSRVTISVDTSKNQFSLKLSSVTAADTAVYYCARDPMYIPNYSYGVMNAWGQGTTVTVSS

SEQ ID NO: 767 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPANGGIYYSEKFKGRVTITADTSAGTAYMELSSLRSEDTAVYYCARPVTMMAPLVFWGQGTLVTVSS

SEQ ID NO: 768 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPANGGIYYSEKFKGRVTITRDTSASTAYMELSSLRSEDTAVYYCARPVTMMAPLVFWGQGTLVTVSS

SEQ ID NO: 769 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSRMYYADTVKGRFTISRDNSKNTLYLQMNSLRAEDTAVYYCASFWWDLDFDYWGQGTMVTVSS

SEQ ID NO: 770 - protein, 123 aa, Artificial Sequence
  source: /note="Description of Artificial Sequence: Synthetic polypeptide"
QVQLQESGPGLVKPSETLSLTCTVSGFSLTTYNIHWIRQPPGKGLEWIGRMRYSGDTSYSSALKSRVTISRDTSKNQVSLKLSSVTAADTAVYYCTRDPMYIPGYSYGVMNAWGQGTTVTVSS

SEQ ID NO: 771 - protein, 115 aa, Artificial Sequence
  source: /note="Description of Artificial Sequence: Synthetic polypeptide"
QVQLVESGGGVVQPGRSLRLSCAASGFAFRKYGMSWVRQAPGKGLEWVALIYYDSSKMNYADTVKGRFTISRDNSKNTLYLQMNSLRAEDTAVYYCAALNSEYDWGQGTMVTVSS

SEQ ID NO: 772 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCAKFWWDLDFDHWGQGTMVTVSS

SEQ ID NO: 773 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFWWDLDFDHWGQGTMVTVSS

SEQ ID NO: 774 - protein, 118 aa, Artificial Sequence
  source: /note="Description of Artificial Sequence: Synthetic polypeptide"
EVKLVESGGDLVQPGDSLTLSCVASGFTFSKQGMHWIRQAPKKGLEWIAMIYYDSSKMYYADTVKGRFTISRDNSKNTLYLEMNSLRSEDTAMYYCASFWWDLDFDHWGQGVMVTVSS

SEQ ID NO: 775 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFYYDLDFDHWGQGTMVTVSS

SEQ ID NO: 776 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSSDLDFDHWGQGTMVTVSS

SEQ ID NO: 777 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWSDLDFDHWGQGTMVTVSS

SEQ ID NO: 778 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSWDLDFDHWGQGTMVTVSS

SEQ ID NO: 779 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFTTDLDFDHWGQGTMVTVSS

SEQ ID NO: 780 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFTWDLDFDHWGQGTMVTVSS

SEQ ID NO: 781 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWTDLDFDHWGQGTMVTVSS

SEQ ID NO: 782 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFWWDLDFDHWGQGTMVTVSS

SEQ ID NO: 783 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFWWDLDFDHWGQGTMVTVSS

SEQ ID NO: 784 - protein, 123 aa, Artificial Sequence
  source: /note="Description of Artificial Sequence: Synthetic polypeptide"
EVQLVESGGGLVQPGGSLRLSCAASGFSLTTYNVHWVRQAPGKGLEWVGRMRYSGDTSFNAALTSRFTISRDNSKNTLYLQMNSLRAEDTAVYYCASDPMYIPNYAYGVMNAWGQGTLVTVSS

SEQ ID NO: 785 - protein, 123 aa, Artificial Sequence
  source: /note="Description of Artificial Sequence: Synthetic polypeptide"
EVQLVETGGGLVQPGGSRRLSCAASGFSLTTYNVHWVRQAPGKGLEWVGRMRYSGDTSFNAALTSRFTISRDTSKNTVYLQMNSLRAEDTGVYYCASDPMYIPNYAYGVMNAWGQGTLVTVSS

SEQ ID NO: 786 - protein, 123 aa, Artificial Sequence
  source: /note="Description of Artificial Sequence: Synthetic polypeptide"
EVQLVETGGGLVQPGGSRRLSCAASGFSLTTYNVHWVRQAPGKGLEWVSRMRYSGDTSFNAALTSRFTISRDTSKNTVYLQMNSLRAEDTGVYYCASDPMYIPNYAYGVMNAWGQGTLVTVSS

SEQ ID NO: 787 - protein, 122 aa, Artificial Sequence
  source: /note="Description of Artificial Sequence: Synthetic polypeptide"
VQLVESGGGLVQPGGSLRLSCAASGFSLTTYNVHWVRQAPGKGLEWVSRMRYSGDTSFNAALTSRFTISRDNSKNTLYLQMNSLRAEDTAVYYCASDPMYIPNYAYGVMNAWGQGTLVTVSS

SEQ ID NO: 788 - protein, 123 aa, Artificial Sequence
  source: /note="Description of Artificial Sequence: Synthetic polypeptide"
EVQLVESGGGSVQPGGSLRLSCTASGFSLTTYNVHWVRQAPGKGLEWVGRMRYSGDTSFNAALTSRFTISRDTSKNTVYLQMNSLRAEDTATYYCASDPMYIPNYAYGVMNAWGQGTTVTVSS

SEQ ID NO: 789 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFYYDLDFDHWGQGTMVTVSS

SEQ ID NO: 790 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYYYDLDFDHWGQGTMVTVSS

SEQ ID NO: 791 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSYYDLDFDHWGQGTMVTVSS

SEQ ID NO: 792 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYYYDLDFDHWGQGTMVTVSS

SEQ ID NO: 793 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSYYDLDFDHWGQGTMVTVSS

SEQ ID NO: 794 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSSDLDFDHWGQGTMVTVSS

SEQ ID NO: 795 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYSSDLDFDHWGQGTMVTVSS

SEQ ID NO: 796 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSSDLDFDHWGQGTMVTVSS

SEQ ID NO: 797 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSSDLDFDHWGQGTMVTVSS

SEQ ID NO: 798 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSSDLDFDHWGQGTMVTVSS

SEQ ID NO: 799 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWSDLDFDHWGQGTMVTVSS

SEQ ID NO: 800 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSWSDLDFDHWGQGTMVTVSS

SEQ ID NO: 801 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWSDLDFDHWGQGTMVTVSS

SEQ ID NO: 802 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWSDLDFDHWGQGTMVTVSS

SEQ ID NO: 803 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFWSDLDFDHWGQGTMVTVSS

SEQ ID NO: 804 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYSWDLDFDHWGQGTMVTVSS

SEQ ID NO: 805 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSWDLDFDHWGQGTMVTVSS

SEQ ID NO: 806 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSWDLDFDHWGQGTMVTVSS

SEQ ID NO: 807 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSWDLDFDHWGQGTMVTVSS

SEQ ID NO: 808 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSWDLDFDHWGQGTMVTVSS

SEQ ID NO: 809 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYTWDLDFDHWGQGTMVTVSS

SEQ ID NO: 810 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSTWDLDFDHWGQGTMVTVSS

SEQ ID NO: 811 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYTWDLDFDHWGQGTMVTVSS

SEQ ID NO: 812 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSTWDLDFDHWGQGTMVTVSS

SEQ ID NO: 813 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFTWDLDFDHWGQGTMVTVSS

SEQ ID NO: 814 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYTTDLDFDHWGQGTMVTVSS

SEQ ID NO: 815 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSTTDLDFDHWGQGTMVTVSS

SEQ ID NO: 816 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYTTDLDFDHWGQGTMVTVSS

SEQ ID NO: 817 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSTTDLDFDHWGQGTMVTVSS

SEQ ID NO: 818 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFTTDLDFDHWGQGTMVTVSS

SEQ ID NO: 819 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWWDLDFDHWGQGTMVTVSS

SEQ ID NO: 820 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS

SEQ ID NO: 821 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYWWDLDFDHWGQGTMVTVSS

SEQ ID NO: 822 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSWWDLDFDHWGQGTMVTVSS

SEQ ID NO: 823 - protein, 118 aa, Artificial Sequence
  source: /note="Description of Artificial Sequence: Synthetic polypeptide"
QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYWWDLDFDHWGQGTMVTVSS

SEQ ID NO: 824 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSWWDLDFDHWGQGTMVTVSS

SEQ ID NO: 825 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYSWDLDFDHWGQGTMVTVSS

SEQ ID NO: 826 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSSWDLDFDHWGQGTMVTVSS

SEQ ID NO: 827 - protein, 118 aa, Artificial Sequence
  source: /note="Description of Artificial Sequence: Synthetic polypeptide"
QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYSWDLDFDHWGQGTMVTVSS

SEQ ID NO: 828 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSSWDLDFDHWGQGTMVTVSS

SEQ ID NO: 829 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFSWDLDFDHWGQGTMVTVSS

SEQ ID NO: 830 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASFSWDLDFDHWGQGTMVTVSS

SEQ ID NO: 831 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWWDLDFDHWGQGTMVTVSS

SEQ ID NO: 832 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSWWDLDFDHWGQGTMVTVSS

SEQ ID NO: 833 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYWWDLDFDHWGQGTMVTVSS

SEQ ID NO: 834 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSWWDLDFDHWGQGTMVTVSS

SEQ ID NO: 835 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYWWDLDFDHWGQGTMVTVSS

SEQ ID NO: 836 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSWWDLDFDHWGQGTMVTVSS

SEQ ID NO: 837 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYSWDLDFDHWGQGTMVTVSS

SEQ ID NO: 838 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSSWDLDFDHWGQGTMVTVSS

SEQ ID NO: 839 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYSWDLDFDHWGQGTMVTVSS

SEQ ID NO: 840 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSSWDLDFDHWGQGTMVTVSS

SEQ ID NO: 841 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASFSWDLDFDHWGQGTMVTVSS

SEQ ID NO: 842 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFSWDLDFDHWGQGTMVTVSS

SEQ ID NO: 843 - protein, 112 aa, Artificial Sequence
  source: /note="Description of Artificial Sequence: Synthetic polypeptide"
DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK

SEQ ID NO: 844 - protein, 112 aa, Artificial Sequence
  source: /note="Description of Artificial Sequence: Synthetic polypeptide"
DVVMTQSPLSLPVTLGQPASISCRSSQSLIYSIGNTYLHWYQQRPGQSPRLLIYRVSNRFSGVPDRFSGSGSGTDFTLKISRVEAEDVGVYYCFQSTHLPYTFGQGTKLEIK

SEQ ID NO: 845 - protein, 112 aa, Artificial Sequence
  source: /note="Description of Artificial Sequence: Synthetic polypeptide"
VVVLTQTPVSLPVSLGGQASISCRSSQSLIYSIGNTYLHWYLQKPGQSPQLLIYRVSNRFSGVPDRFSGSGSGTDFTLKISRVEPEDLGDYYCFQSTHLPYTFGAGTKLELK

SEQ ID NO: 846 - protein, 106 aa, Artificial Sequence
  source: /note="Description of Artificial Sequence: Synthetic polypeptide"
DIQMTQSPSSLSASVGDRVTITCKASQNINNYLNWYQQKPGKAPKLLIYNTDHLQAGVPSRFSGSGSGTDYTLTISSLQPEDFATYFCLQHRSRYTFGPGTKVDIK

SEQ ID NO: 847 - protein, 106 aa, Artificial Sequence
  source: /note="Description of Artificial Sequence: Synthetic polypeptide"
DIQMTQSPSSLSASVGDRVTITCKASQNINNYLNWYQQKPGKAPKLLIYNTDHLQAGVPSRFSGSGSGTDFTLTISSLQPEDFATYYCLQHRSRYTFGPGTKVDIK

SEQ ID NO: 848 - protein, 112 aa, Artificial Sequence
  source: /note="Description of Artificial Sequence: Synthetic polypeptide"
DVVMTQSPLSLPVTLGQPASISCRSSQSLVYSHGNTYLHWYQQRPGQSPRLLIYRVSNRFSGVPDRFSGSGSGTDFTLKISRVEAEDVGVYYCFQSTHLPYTFGQGTKLEIK

SEQ ID NO: 849 - protein, 112 aa, Artificial Sequence
  source: /note="Description of Artificial Sequence: Synthetic polypeptide"
DVVMTQSPLSLPVTLGQPASISCRSSQSLVYSHGNTYLHWFQQRPGQSPRRLIYRVSNRFSGVPDRFSGSGSGTDFTLKISRVEAEDVGVYYCFQSTHLPYTFGQGTKLEIK

SEQ ID NO: 850 - protein, 106 aa, Artificial Sequence
  source: /note="Description of Artificial Sequence: Synthetic polypeptide"
DIQMTQSPSSLSASVGDRVTITCKTSQNIDKYLNWYQQKPGKAPKLLIYNTNNLEAGVPSRFSGSGSGTDYTFTISSLQPEDIATYFCLQHRSSYTFGQGTKLEIK

SEQ ID NO: 851 - protein, 107 aa, Artificial Sequence
  source: /note="Description of Artificial Sequence: Synthetic polypeptide"
DIQMTQSPSSLSASVGDRVTITCRGSQSIGNSLNWYQQKPGKAPKRLIYSTSTLEYGVPSRFSGSGSGTEYTLTISSLQPEDFATYYCLQYATYPYTFGQGTKLEIK

SEQ ID NO: 852 - protein, 106 aa, Artificial Sequence
  source: /note="Description of Artificial Sequence: Synthetic polypeptide"
DIQMTQSPSSLSASVGDRVTITCKSSQNIDKYLNWYQQKPGKAPKLLIYNTNNLEAGVPSRFSGSGSGTDYTFTISSLQPEDIATYFCLQHRSGYTFGQGTKLEIK

SEQ ID NO: 853 - protein, 112 aa, Artificial Sequence
  source: /note="Description of Artificial Sequence: Synthetic polypeptide"
DIVMTQTPLSSPVTLGQPASISCRSSQSLVRSDGTTYFNWLQQRPGQPPRLLIYRVSNRFSGVPDRFSGSGAGTDFTLKISRVEAEDVGVYYCLQSSHFPWTFGGGTKVEIK

SEQ ID NO: 854 - protein, 98 aa, Artificial Sequence
  source: /note="Description of Artificial Sequence: Synthetic polypeptide"
DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSH

SEQ ID NO: 855 - protein, 112 aa, Artificial Sequence
  source: /note="Description of Artificial Sequence: Synthetic polypeptide"
DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK

SEQ ID NO: 856 - protein, 112 aa, Artificial Sequence
  source: /note="Description of Artificial Sequence: Synthetic polypeptide"
DILVTQTPVSLPVSLGGHVSISCRSSQSLVRSEGTTYFNWYLQKPGQSPQLLIYRVSNRFSGVPDRFSGSGSGTDFTLKISRVEPEDLGVYYCLQSSHFPWTFGGGTKLELK

SEQ ID NO: 857 - protein, 112 aa, Artificial Sequence
  source: /note="Description of Artificial Sequence: Synthetic polypeptide"
EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK

SEQ ID NO: 858 - protein, 112 aa, Artificial Sequence
  source: /note="Description of Artificial Sequence: Synthetic polypeptide"
DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK

SEQ ID NO: 859 - protein, 106 aa, Artificial Sequence
  source: /note="Description of Artificial Sequence: Synthetic polypeptide"
EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL

SEQ ID NO: 860 - protein, 112 aa, Artificial Sequence
  source: /note="Description of Artificial Sequence: Synthetic polypeptide"
EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK

SEQ ID NO: 861 - protein, 112 aa, Artificial Sequence
  source: /note="Description of Artificial Sequence: Synthetic polypeptide"
DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK

SEQ ID NO: 862 - protein, 714 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSGGGGSGGGGSQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 863 - protein, 326 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 864 - protein, 562 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 865 - protein, 478 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSGGGGSGGGGSQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 866 - protein, 365 aa, Artificial Sequence
  source: /note="Description of Artificial Sequence: Synthetic polypeptide"
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 867 - protein, 722 aa, Artificial Sequence
  source: /note="Description of Artificial Sequence: Synthetic polypeptide"
QVQLVESGGGVVQPGRSLRLSCAASGFTVSSYGMHWVRQAPGKGLEWVAVISYTGSNKYYADSVKGRFTISRDNSKNTLYLQMNSLRAEDTAVYYCGGSGYALHDDYYGLDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 868 - protein, 486 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 869 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 870 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 871 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 872 - protein, 225 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

What is claimed is:

1. A multispecific binding molecule (MBM), comprising:
(a) an antigen-binding module 1 (ABM1) that binds specifically to human BCMA and comprises
  (i) according to the Kabat definition CDR-L1, CDR-L2 and CDR-L3 sequences set forth in SEQ ID NOs: 100, 175, and 183, respectively, and CDR-H1, CDR-H2 and CDR-H3 sequences set forth in SEQ ID NOs: 112, 185, and 122, respectively;
  (ii) according to the Chothia definition CDR-L1, CDR-L2 and CDR-L3 sequences set forth in SEQ ID NOs: 101, 105, and 209, respectively, and CDR-H1, CDR-H2 and CDR-H3 sequences set forth in SEQ ID NOs: 211, 213, and 122, respectively; or
  (iii) according to the IMGT definition CDR-L1, CDR-L2 and CDR-L3 sequences set forth in SEQ ID NOs: 102, 105, and 183, respectively, and CDR-H1, CDR-H2 and CDR-H3 sequences set forth in SEQ ID NOs: 235, 238, and 124, respectively;
  (iv) according to the combined Kabat and Chothia definitions CDR-L1, CDR-L2 and CDR-L3 sequences set forth in SEQ ID NOs: 100, 175, and 183, respectively, and CDR-H1, CDR-H2 and CDR-H3 sequences set forth in SEQ ID NOs: 261, 185, and 122, respectively;
  (v) according to the combined Kabat and IMGT definitions CDR-L1, CDR-L2 and CDR-L3 sequences set forth in SEQ ID NOs: 100, 175, and 183, respectively, and CDR-H1, CDR-H2 and CDR-H3 sequences set forth in SEQ ID NOs: 261, 185, and 124, respectively; or
  (vi) according to the combined Chothia and IMGT definitions CDR-L1, CDR-L2 and CDR-L3 sequences set forth in SEQ ID NOs: 101, 105, and 183, respectively, and CDR-H1, CDR-H2 and CDR-H3 sequences set forth in SEQ ID NOs: 235, 238, and 124, respectively;
(b) an antigen-binding module 2 (ABM2) that binds specifically to a component of a human T-cell receptor (TCR) complex; and
(c) an antigen-binding module 3 (ABM3) that binds specifically to human CD2 or a human tumor-associated antigen (TAA).

2. The MBM of claim 1, wherein ABM1 comprises a light chain variable sequence set forth in SEQ ID NO:273 and a heavy chain variable sequence set forth in SEQ ID NO:297.

5. The MBM of claim 1, wherein the component of the TCR complex is TCR-α, TCR-β, a TCR-α/β dimer, TCR-γ, TCR-δ, or a TCR-γ/δ dimer.

6. The MBM of claim 1, wherein ABM3 binds specifically to human CD2.

7. The MBM of claim 6, wherein ABM3 is a non-immunoglobulin scaffold based ABM and comprises a receptor binding domain of a CD2 ligand.

8. The MBM of claim 7, wherein ABM3 is a CD58 moiety.

9. The MBM of claim 8, wherein the CD58 moiety comprises the amino acid sequence as set forth in SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO:522, SEQ ID NO: 523, SEQ ID NO:524, or SEQ ID NO:525.

10. The MBM of claim 1, wherein ABM3 binds specifically to a human TAA.

11. The MBM of claim 10, wherein the TAA is selected from CD19, CD20, CD22, CD123, CD33, CLL1, CD138, CS1, CD38, CD133, FLT3, CD52, TNFRSF13C, TNFRSF13B, CXCR4, PD-L1, LY9, CD200, FCGR2B, CD21, CD23, CD24, CD40L, CD72, CD79a, and CD79b.

12. The MBM of claim 1, which comprises an Fc domain.

13. The MBM of claim 12, wherein the Fc domain is an Fc heterodimer.

14. A conjugate comprising the MBM of claim 1, and a therapeutic agent, a diagnostic agent, a masking moiety, a cleavable moiety, or any combination thereof.

15. A preparation of MBMs comprising a plurality of MBMs molecules according to claim 1, wherein the plurality comprises at least 100 conjugate molecules.

16. A pharmaceutical composition comprising the MBM of claim 1, and an excipient.

17. A method of treating a subject having an autoimmune disorder associated with expression of BCMA, comprising administering to the subject an effective amount of the MBM of claim 1, wherein the autoimmune disorder is selected from systemic lupus erythematosus (SLE), Sjögren's syndrome, scleroderma, rheumatoid arthritis (RA), juvenile idiopathic arthritis, graft versus host disease, dermatomyositis, type I diabetes mellitus, Hashimoto's thyroiditis, Graves's disease, Addison's disease, celiac disease, Crohn's Disease, pernicious anaemia, pemphigus vulgaris, vitiligo, autoimmune haemolytic anaemia, idiopathic thrombocytopenic purpura, giant cell arteritis, myasthenia gravis, multiple sclerosis (MS), glomerulonephritis, Goodpasture's syndrome, bullous pemphigoid, ulcerative colitis, Guillain-Barré syndrome, chronic inflammatory demyelinating polyneuropathy, anti-phospholipid syndrome, narcolepsy, sarcoidosis, and Wegener's granulomatosis.

18. The method of claim 17, wherein the autoimmune disorder is relapsing-remitting multiple sclerosis (RRMS).

19. A method of treating a subject having a BCMA expressing cancer, comprising administering to the subject an effective amount of the MBM of claim 1.

20. The method of claim 19, wherein the cancer is a B cell malignancy selected from selected from Hodgkin's lymphoma, non-Hodgkin's lymphoma and multiple myeloma.

21. A nucleic acid or plurality of nucleic acids encoding the MBM of claim 1.

22. A cell engineered to express the MBM of claim 1.

23. A cell transfected with one or more expression vectors comprising one or more nucleic acid sequences encoding the MBM of claim 1 under the control of one or more promoters.

24. A method of producing a MBM, comprising:
(a) culturing the cell of claim 22 in conditions under which the MBM is expressed; and
(b) recovering the MBM from the cell culture.

25. The MBM of claim 1, wherein ABM1 comprises CDR-L1, CDR-L2 and CDR-L3 sequences set forth in SEQ ID NOs: 100, 175, and 183, respectively, and CDR-H1, CDR-H2 and CDR-H3 sequences set forth in SEQ ID NOs: 112, 185, and 122, respectively.

\* \* \* \* \*